US007935812B2

(12) United States Patent
McSwiggen et al.

(10) Patent No.: US 7,935,812 B2
(45) Date of Patent: May 3, 2011

(54) RNA INTERFERENCE MEDIATED INHIBITION OF HEPATITIS C VIRUS (HCV) EXPRESSION USING SHORT INTERFERING NUCLEIC ACID (SINA)

(75) Inventors: James McSwiggen, Bothell, WA (US); David Morrissey, Winchester, MA (US); Roberto Guerciolini, Hillsborough, CA (US); Chandra Vargeese, Schwenksville, PA (US); Vasant Jadhav, Harleysville, PA (US)

(73) Assignee: Merck Sharp & Dohme Corp., Rahway, NJ (US)

( * ) Notice: Subject to any disclaimer, the term of this patent is extended or adjusted under 35 U.S.C. 154(b) by 0 days.

(21) Appl. No.: 12/418,477

(22) Filed: Apr. 3, 2009

(65) Prior Publication Data

US 2009/0306184 A1 Dec. 10, 2009

Related U.S. Application Data

(63) Continuation-in-part of application No. 12/158,276, filed as application No. PCT/US2006/062252 on Dec. 18, 2006, now abandoned, which is a continuation-in-part of application No. 11/510,872, filed on Aug. 25, 2006, now abandoned, which is a continuation-in-part of application No. 11/311,826, filed on Dec. 19, 2005, now abandoned, which is a continuation-in-part of application No. 10/942,560, filed on Sep. 15, 2004, now abandoned, which is a continuation-in-part of application No. 10/667,271, filed on Sep. 16, 2003, now abandoned, which is a continuation-in-part of application No. PCT/US03/05043, filed on Feb. 20, 2003, which is a continuation-in-part of application No. PCT/US02/09187, filed on Mar. 26, 2002, said application No. 12/158,276 is a continuation-in-part of application No. PCT/US2006/032168, filed on Aug. 17, 2006, which is a continuation-in-part of application No. 11/299,254, filed on Dec. 8, 2005, now abandoned, which is a continuation-in-part of application No. 11/234,730, filed on Sep. 23, 2005, now abandoned, which is a continuation-in-part of application No. 11/205,646, filed on Aug. 17, 2005, now abandoned, which is a continuation-in-part of application No. 11/098,303, filed on Apr. 4, 2005, now abandoned, which is a continuation-in-part of application No. 10/923,536, filed on Aug. 20, 2004, now abandoned, which is a continuation-in-part of application No. PCT/US2004/016390, filed on May 24, 2004, which is a continuation-in-part of application No. 10/826,966, filed on Apr. 16, 2004, now abandoned, which is a continuation-in-part of application No. 10/757,803, filed on Jan. 14, 2004, which is a continuation-in-part of application No. 10/720,448, filed on Nov. 24, 2003, which is a continuation-in-part of application No. 10/693,059, filed on Oct. 23, 2003, now abandoned, which is a continuation-in-part of application No. 10/444,853, filed on May 23, 2003, which is a continuation-in-part of application No. PCT/US03/05346, filed on Feb. 20, 2003, and a continuation-in-part of application No. PCT/US03/05028, filed on Feb. 20, 2003, said application No. 12/158,276 is a continuation-in-part of application No. PCT/US2005/004270, filed on Feb. 9, 2005, and a continuation-in-part of application No. 11/353,630, filed on Feb. 14, 2006, now Pat. No. 7,514,099.

(60) Provisional application No. 60/401,104, filed on Aug. 5, 2002, provisional application No. 60/358,580, filed on Feb. 20, 2002, provisional application No. 60/363,124, filed on Mar. 11, 2002, provisional application No. 60/386,782, filed on Jun. 6, 2002, provisional application No. 60/406,784, filed on Aug. 29, 2002, provisional application No. 60/408,378, filed on Sep. 5, 2002, provisional application No. 60/409,293, filed on Sep. 9, 2002, provisional application No. 60/440,129, filed on Jan. 15, 2003, provisional application No. 60/543,480, filed on Feb. 10, 2004, provisional application No. 60/652,787, filed on Feb. 14, 2005, provisional application No. 60/678,531, filed on May 6, 2005, provisional application No. 60/703,946, filed on Jul. 29, 2005, provisional application No. 60/737,024, filed on Nov. 15, 2005.

(51) Int. Cl.
C07H 21/04 (2006.01)
C07H 21/02 (2006.01)
A61K 48/00 (2006.01)

(52) U.S. Cl. .......... 536/24.5; 536/23.1; 514/44
(58) Field of Classification Search ............ None
See application file for complete search history.

(56) References Cited

U.S. PATENT DOCUMENTS 4,946,787 A 8/1990 Eppstein et al.
(Continued)

FOREIGN PATENT DOCUMENTS

CA 2359180 3/2000
(Continued)

OTHER PUBLICATIONS

Anderson et al. "Bispecific Short Hairpin siRNA Constructs Targeted to CD4, CXCR4, and CCR5 Confer HIV-1 Resistance," Oligonucleotides 13(5):303-312 (2003).

(Continued)

Primary Examiner — Amy Bowman
(74) Attorney, Agent, or Firm — Laura M. Ginkel; David A. Muthard

(57) ABSTRACT

The present invention relates to compounds, compositions, and methods for the study, diagnosis, and treatment of traits, diseases and conditions that respond to the modulation of hepatitis C virus (HCV) gene expression and/or activity. The present invention is also directed to compounds, compositions, and methods relating to traits, diseases and conditions that respond to the modulation of expression and/or activity of genes involved in hepatitis C virus (HCV) gene expression pathways or other cellular processes that mediate the maintenance or development of such traits, diseases and conditions. Specifically, the invention relates to double stranded nucleic acid molecules capable of mediating or that mediate RNA interference (RNAi) against hepatitis C virus (HCV) gene expression, including cocktails of such small nucleic acid molecules and lipid nanoparticle (LNP) formulations of such small nucleic acid molecules.

13 Claims, 37 Drawing Sheets

U.S. PATENT DOCUMENTS

| | | | |
|---|---|---|---|
| 5,814,620 | A | 9/1998 | Robinson et al. |
| 5,998,203 | A | 12/1999 | Matulic-Adamic et al. |
| 5,998,206 | A | 12/1999 | Cowsert |
| 6,670,332 | B1 | 12/2003 | Wheeler |
| 7,404,969 | B2 | 7/2008 | Chen et al. |
| 7,514,099 | B2 | 4/2009 | Chen et al. |
| 2005/0020521 | A1 | 1/2005 | Rana |
| 2005/0020525 | A1 | 1/2005 | McSwiggen et al. |
| 2005/0080246 | A1 | 4/2005 | Allerson et al. |
| 2006/0211642 | A1 | 9/2006 | McSwiggen et al. |
| 2006/0240554 | A1 | 10/2006 | Chen et al. |
| 2008/0020058 | A1 | 1/2008 | Chen et al. |

FOREIGN PATENT DOCUMENTS

| | | |
|---|---|---|
| WO | WO90/14090 | 11/1990 |
| WO | WO94/01550 | 1/1994 |
| WO | WO97/13743 | 4/1997 |
| WO | WO99/32619 | 7/1999 |
| WO | WO99/49029 | 9/1999 |
| WO | WO00/44895 | 8/2000 |
| WO | WO00/44914 | 8/2000 |
| WO | WO01/36646 | 5/2001 |
| WO | WO01/96584 | 3/2002 |
| WO | WO02/22636 | 3/2002 |
| WO | WO02/44321 | 6/2002 |
| WO | WO02/072068 | 9/2002 |
| WO | WO03/064626 | 8/2003 |
| WO | WO2005/007196 | 1/2005 |
| WO | WO2005/026372 | 3/2005 |
| WO | WO2005/028650 | 3/2005 |
| WO | WO2005/120152 | 12/2005 |
| WO | WO2006/128141 | 11/2006 |
| WO | WO2007/022030 | 2/2007 |
| WO | WO2007/067981 | 6/2007 |
| WO | WO2007/076328 | 7/2007 |
| WO | WO2007/086881 | 8/2007 |
| WO | WO2008/011431 | 1/2008 |

OTHER PUBLICATIONS

Elbashir et al. "Analysis of Gene Function in Somatic Mammalian Cells Using Small Interfering RNAs," Methods 26 (2):199-213 (2002).

Elbashir et al. "Duplexes of 21-Nucleotide RNAs Mediate RNA Interference in Cultured Mammalian Cells," Nature 411(6836):494-498 (2001).

Elbashir et al. "Functional Anatomy of siRNAs for Mediating Efficient RNAi in Drosophila melanogaster Embryo Lysate," EMBO J. 20(23):6877-6888 (2001).

Elbashir et al. "RNA Interference is Mediated by 21- and 22-Nucleotide RNAs," Genes Dev. 15(2):188-200 (2001).

Fire et al. "Potent and Specific Genetic Interference by Double-Stranded RNA in Caenorhabditis elegans," Nature 391:806-811 (1998).

Futami et al. "Induction of Apoptosis in HeLa Cells with siRNA Expression Vector Targeted Against Bcl-2," Nucleic Acids Research Supplement 2:251-252 (2002).

International Search Report mailed on Mar. 31, 2005 for PCT/US04/16390, 2 pages.

International Search Report mailed on Oct. 17, 2003 for PCT/US03/05028, 2 pages.

International Search Report mailed on Oct. 17, 2003 for PCT/US03/05346, 1 page.

Leirdal et al. "Gene Silencing in Mammalian Cells by Preformed Small RNA Duplexes," Biochemical and Biophysical Research Communications 295:744-748 (2002).

Lin et al. "A Novel mRNA-cDNA Interference Phenomenon for Silencing Bcl-2 Expression in Human LNCaP Cells," Biochemical and Biophysical Research Communications 281:639-644 (2001).

Tuschl et al. "Small Interfering RNAs: A Revolutionary Tool for the Analysis of Gene Function and Gene Therapy," Molecular Interventions 295(3):158-167 (2002).

Tuschl et al. "Targeted mRNA Degradation by Double-Stranded RNA in Vitro," Genes and Development 13 (24):3191-3197 (1999).

Office Action mailed on Feb. 4, 2008 for U.S. Appl. No. 10/444,853, 37 pages.

Office Action mailed on Jul. 1, 2008 for U.S. Appl. No. 11/499,520, 13 pages.

Office Action mailed on Oct. 8, 2008 for U.S. Appl. No. 11/499,529, 34 pages.

Office Action mailed on Nov. 14, 2008 for U.S. Appl. No. 11/502,875, 14 pages.

Office Action mailed on Apr. 8, 2009 for U.S. Appl. No. 11/502,876, 31 pages.

Office Action mailed on Jan. 26, 2009 for U.S. Appl. No. 11/676,124, 15 pages.

Office Action mailed on Feb. 3, 2009 for U.S. Appl. No. 10/693,059, 7 pages.

Office Action mailed on Jul. 2, 2008 for U.S. Appl. No. 10/757,803, 26 pages.

Office Action mailed on Apr. 16, 2009 for U.S. Appl. No. 12/105,010, 24 pages.

Office Action mailed on Oct. 10, 2008 for U.S. Appl. No. 11/499,521, 37 pages.

Koltover, et al., Science, vol. 281, pp. 78-81 (1998).

McCaffrey, et al., Nature, vol. 418, pp. 38-39 (2002).

Randall, et al., Proceedings of the National Academy of Sciences, vol. 100(1), pp. 235-240 (2003).

Figure 1
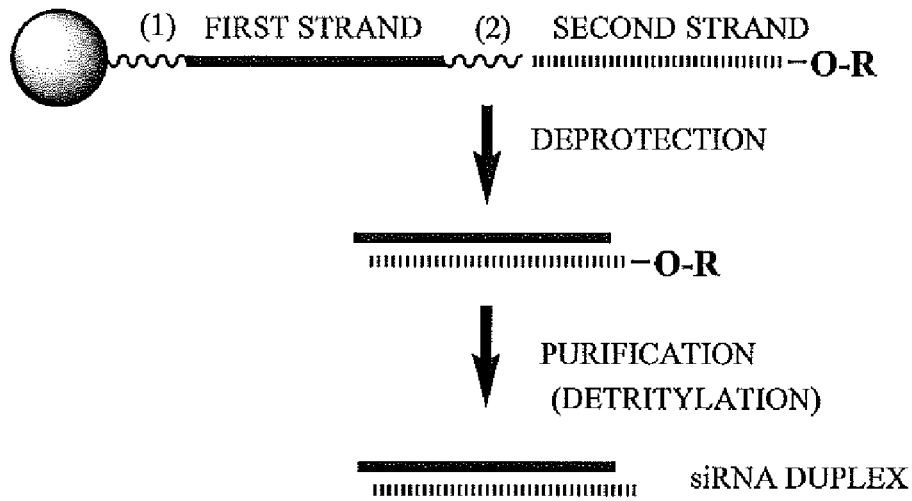
= SOLID SUPPORT
R = TERMINAL PROTECTING GROUP
FOR EXAMPLE:
DIMETHOXYTRITYL (DMT)
 = CLEAVABLE LINKER
(FOR EXAMPLE: NUCLEOTIDE SUCCINATE OR
INVERTED DEOXYABASIC SUCCINATE)
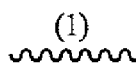 = CLEAVABLE LINKER
(FOR EXAMPLE: NUCLEOTIDE SUCCINATE OR
INVERTED DEOXYABASIC SUCCINATE)
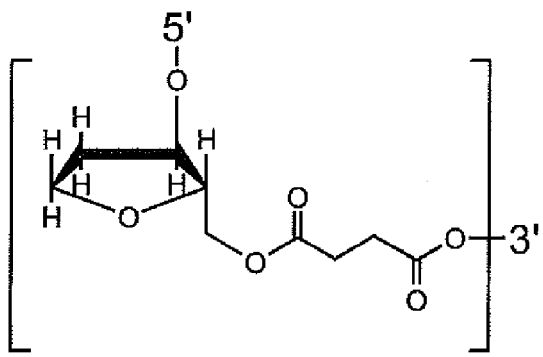
INVERTED DEOXYABASIC SUCCINATE
LINKAGE
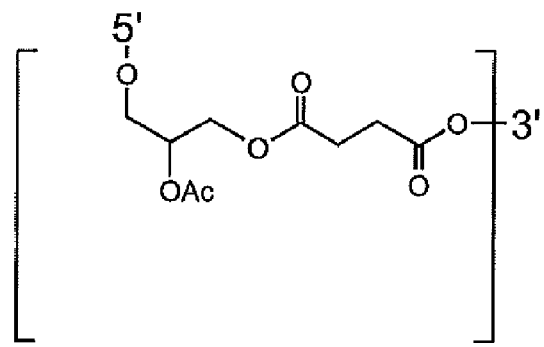
GLYCERYL SUCCINATE LINKAGE POSITIONS (NN) CAN COMPRISE ANY NUCLEOTIDE, SUCH AS DEOXYNUCLEOTIDES (eg. THYMIDINE) OR UNIVERSAL BASES
B = ABASIC, INVERTED ABASIC, INVERTED NUCLEOTIDE OR OTHER TERMINAL CAP THAT IS OPTIONALLY PRESENT
L = GLYCERYL or B THAT IS OPTIONALLY PRESENT
S = PHOSPHOROTHIOATE OR PHOSPHORODITHIOATE that is optionally absent n = 0, 1, 2, 3, 4

Figure 6C

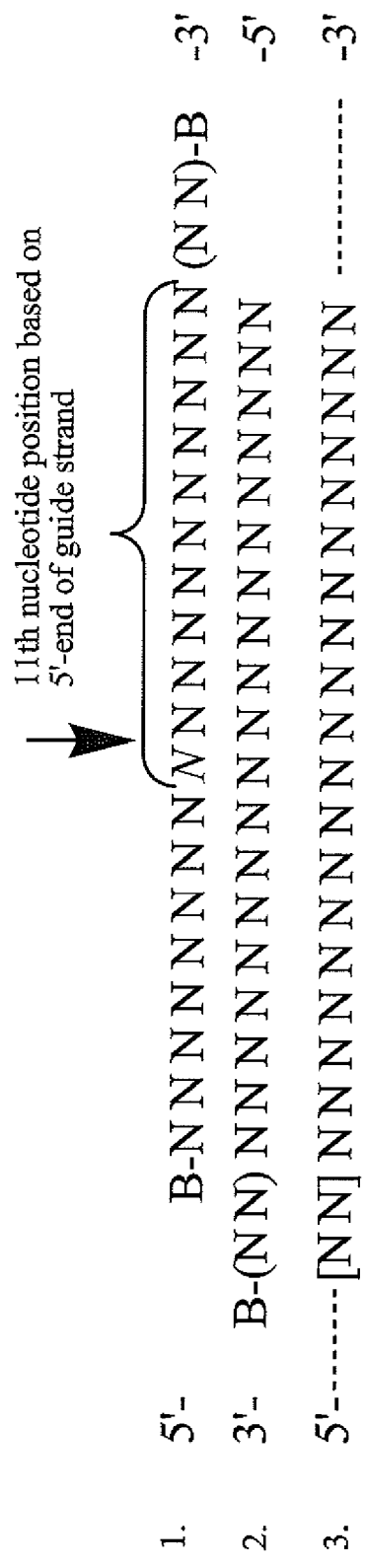

1. = sense strand (passenger strand)
2. = antisense strand (guide strand)
3. = target polynucleotide sequence The guide strand is complementary to the target sequence and the passenger strand is complementary to the guide strand. Overhang nucleotides (NN) in the guide strand can be complementary to nucleotides [NN] in target sequence. Overhang nucleotides (NN) in the passenger strand can comprise nucleotides [NN] in target sequence. Position N of the passenger strand can comprise a ribonucleotide. For the representative 19 base pair 21 mer duplex shown, position N is 9 nucleotides in from the 3' end of the passenger strand. However, in duplexes of differing length, the position N is determined based on the 5'-end of the guide strand by counting 11 nucleotide positions in from the 5'-terminus of the guide strand and picking the corresponding base paired nucleotide in the passenger strand. Cleavage by Ago2 takes place between positions 10 and 11 as indicated by the arrow.
Representative 2 nucleotide overhangs are shown, but can vary for example from 0 to about 4 nucleotides.
B = terminal cap which can be present or absent
This generalized motif can be applied to all Stab 00-34 chemistries herein.

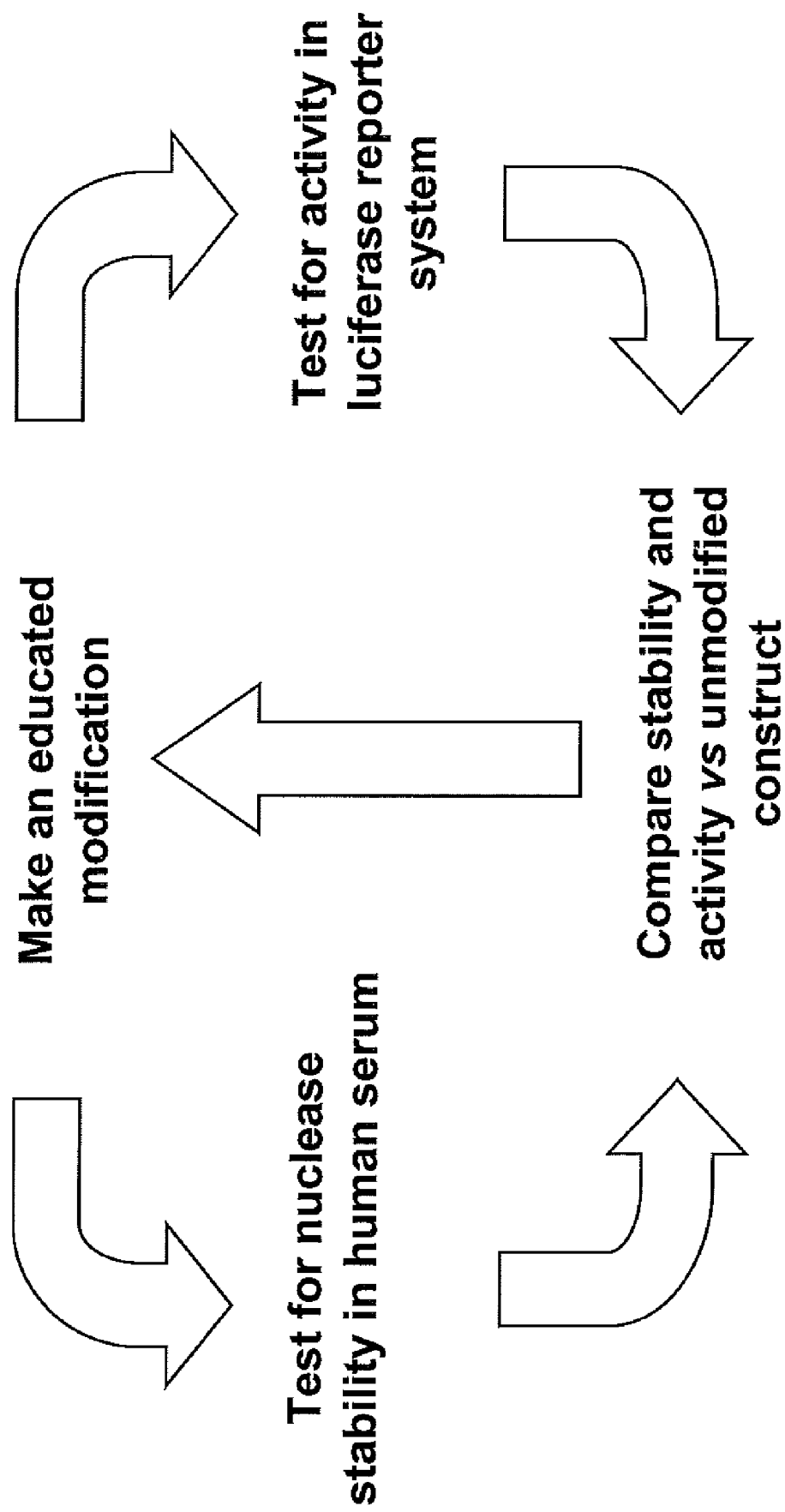
Figure 11: Modification Strategy

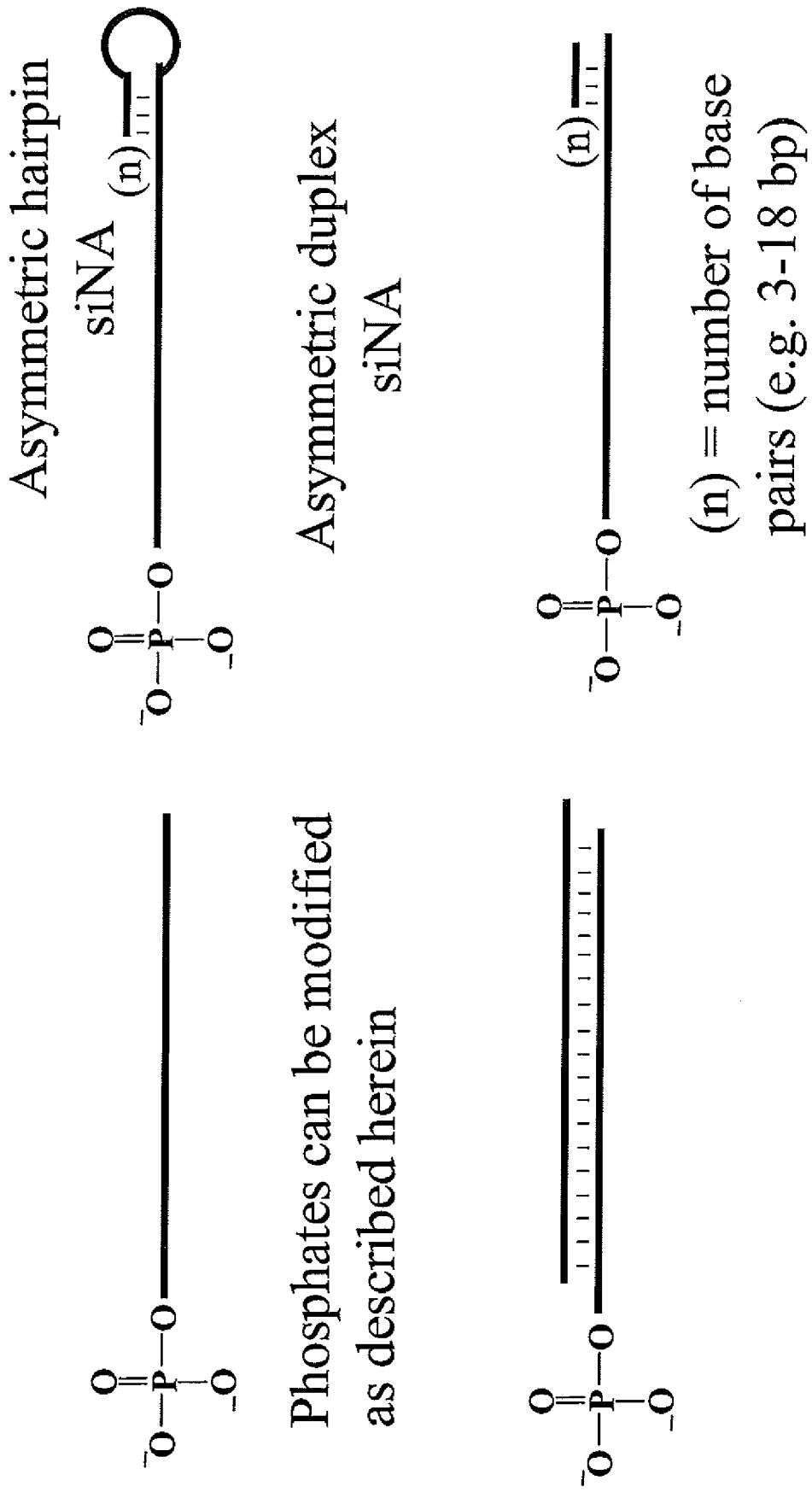
Figure 12: Phosphorylated siNA constructs

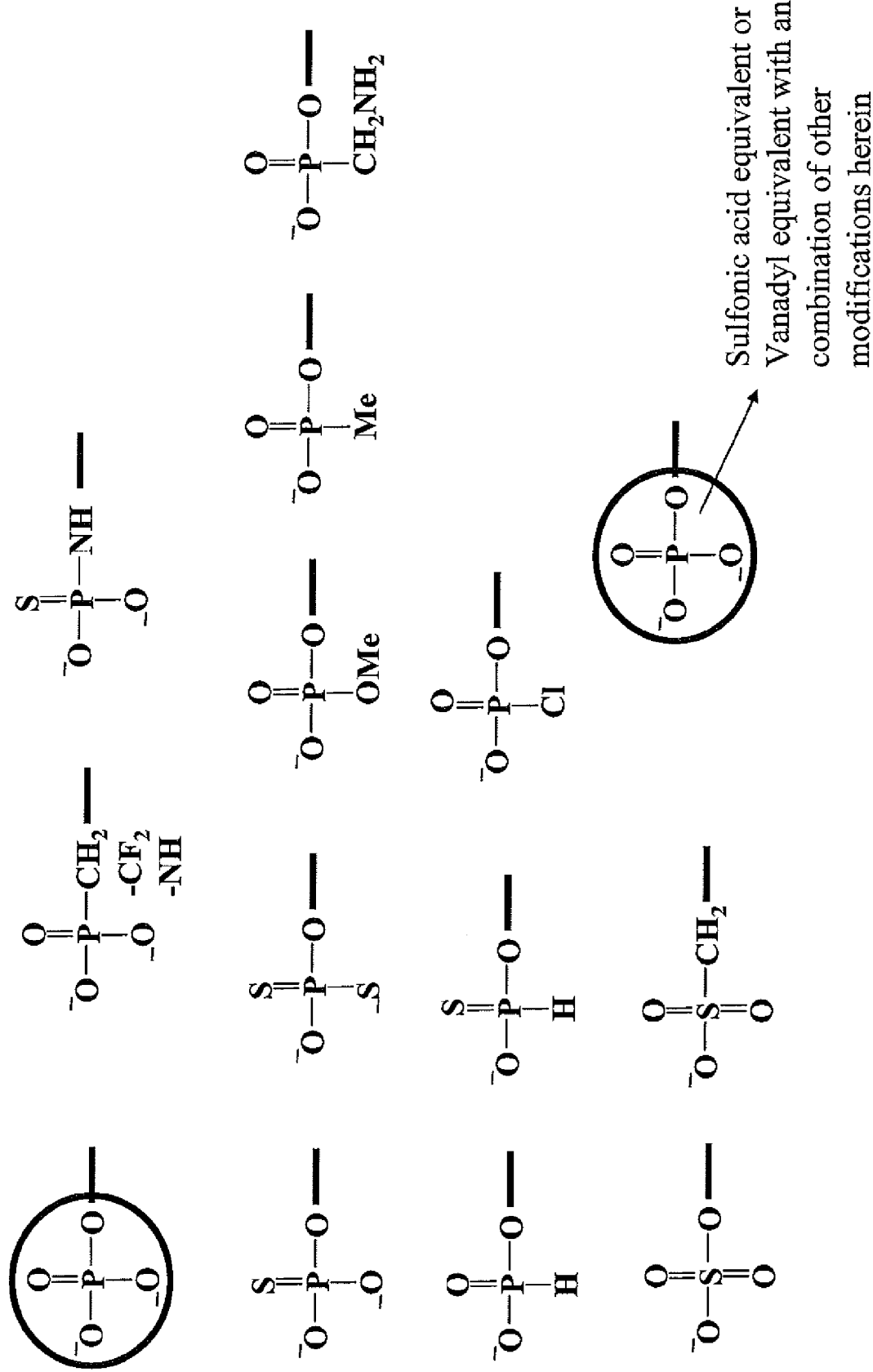
Figure 13: 5'-phosphate modifications

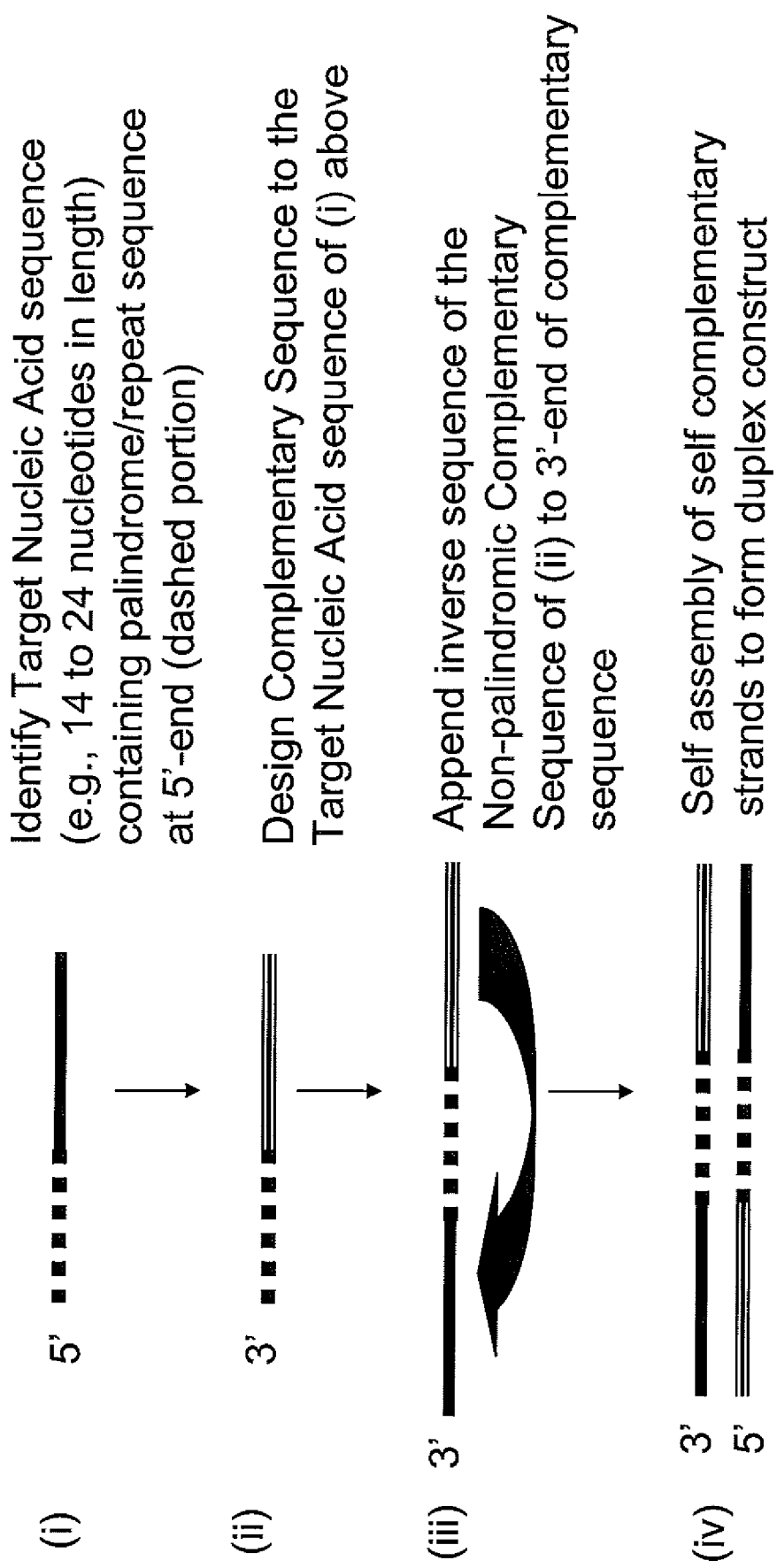
Figure 14A: Duplex forming oligonucleotide constructs that utilize Palindrome or repeat sequences

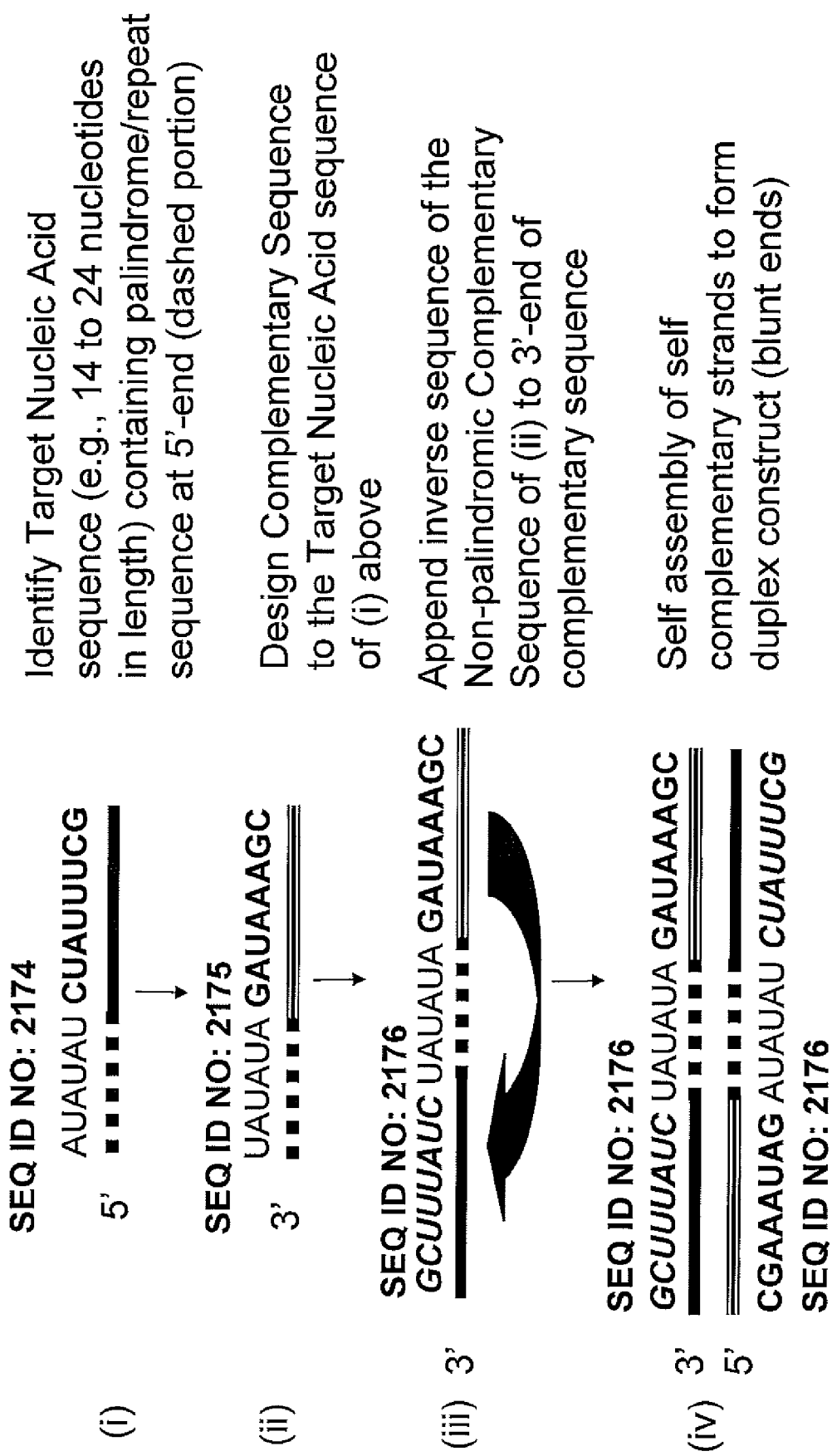
Figure 14B: Example of a duplex forming oligonucleotide sequence that utilizes a palindrome or repeat sequence

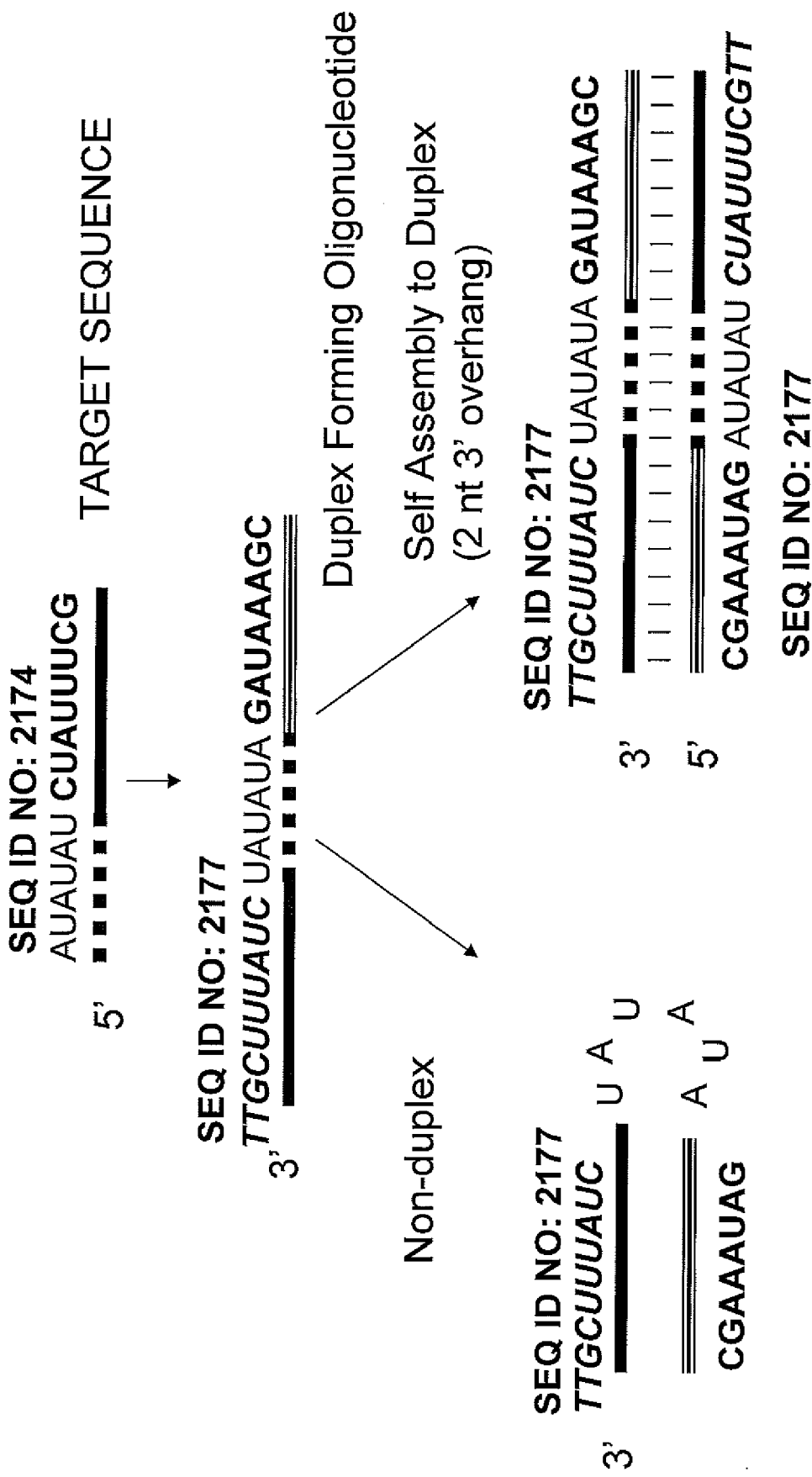
Figure 14C: Example of a duplex forming oligonucleotide sequence that utilizes a palindrome or repeat sequence, self assembly

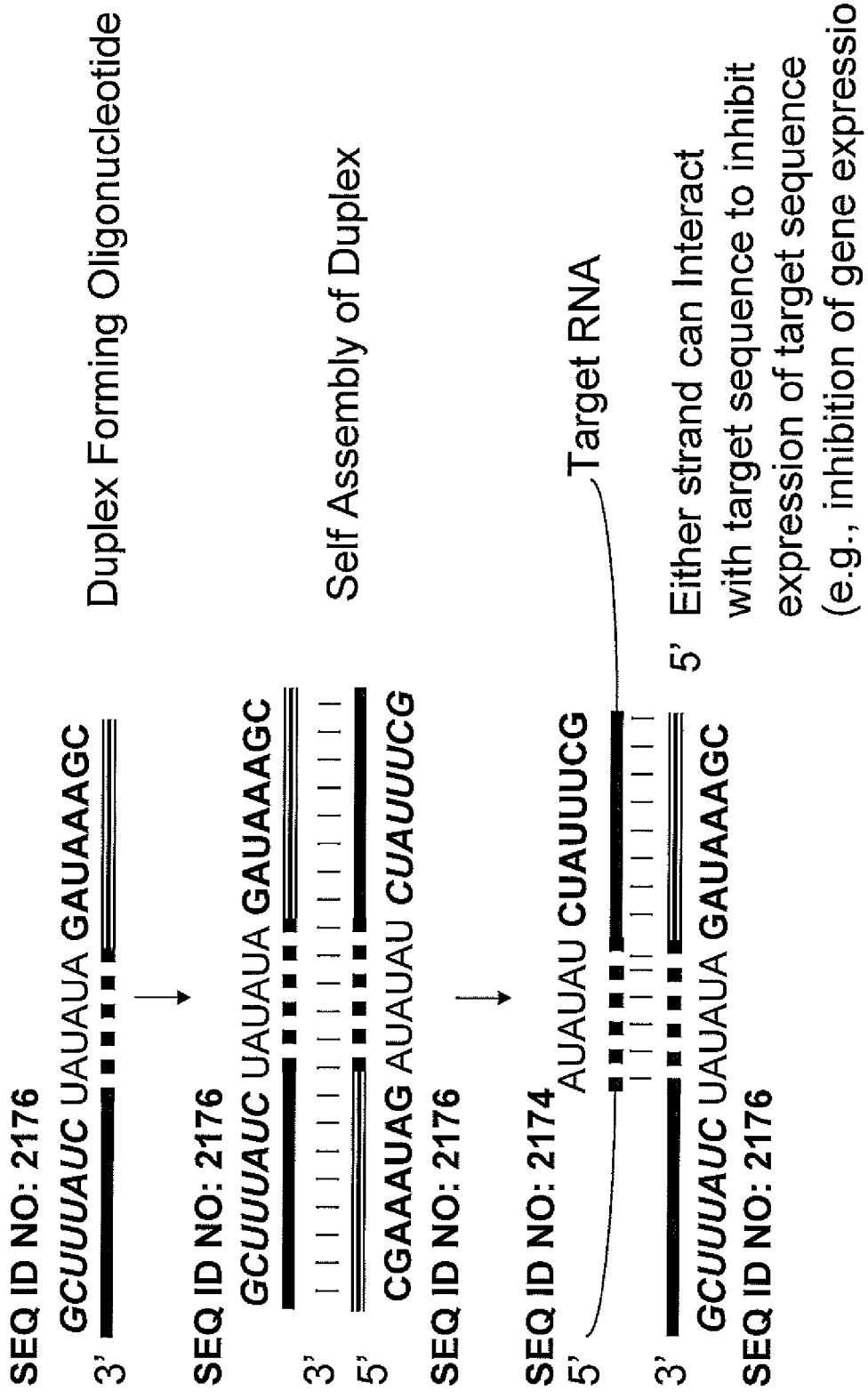
Figure 14D: Example of a duplex forming oligonucleotide sequence that utilizes a palindrome or repeat sequence, self assembly and inhibition of Target Sequence Expression

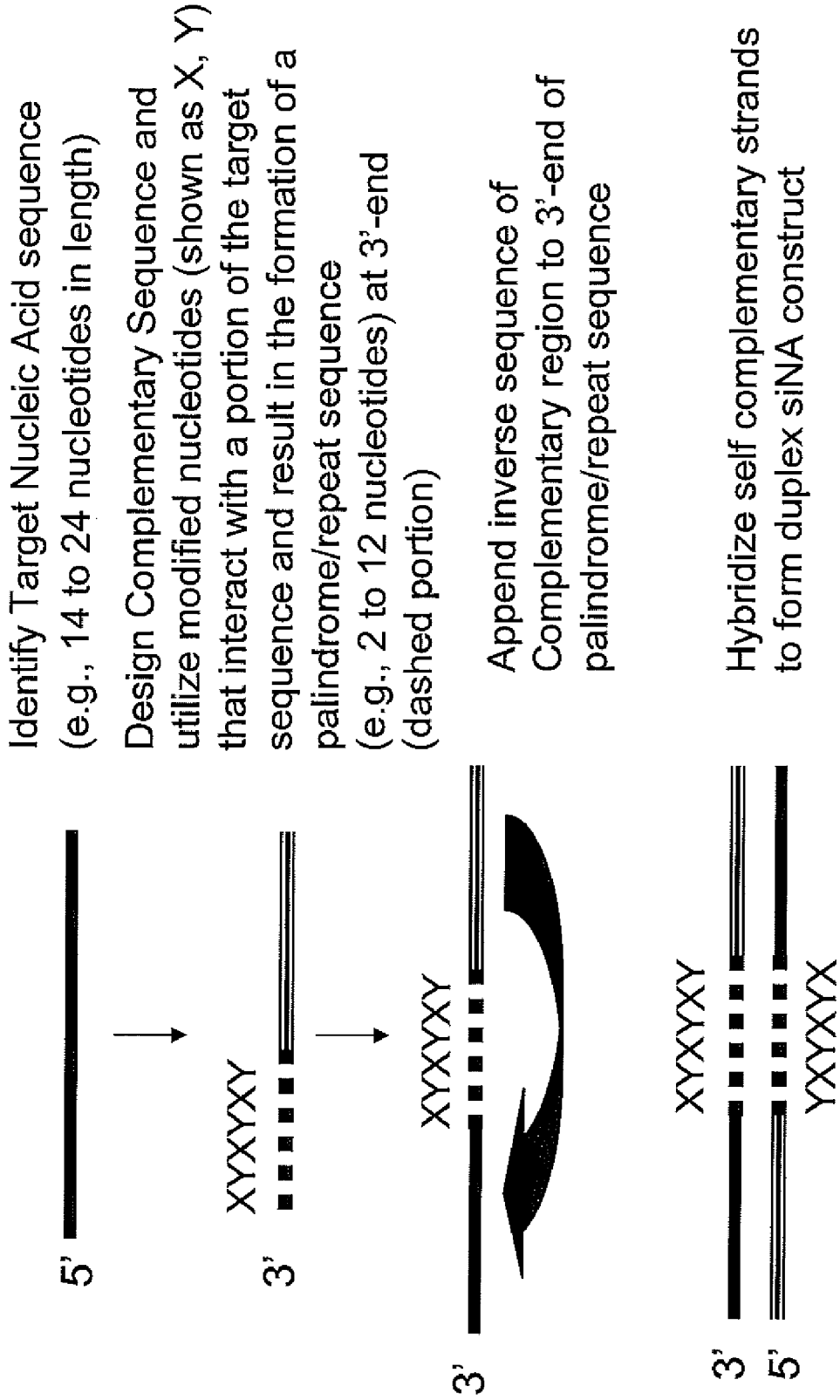
Figure 15: Duplex forming oligonucleotide constructs that utilize artificial palindrome or repeat sequences

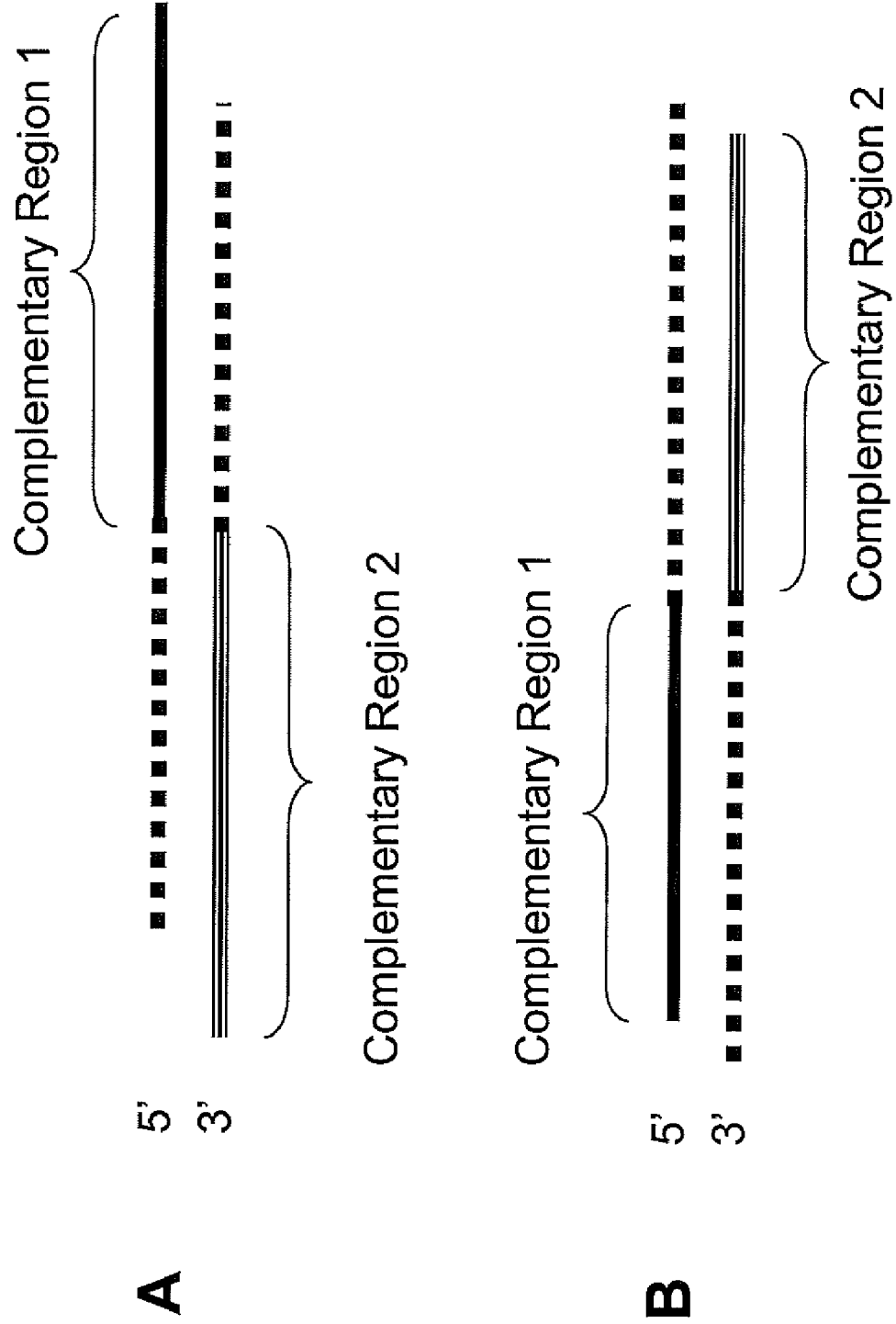
Figure 16: Examples of double stranded multifunctional siNA constructs with distinct complementary regions

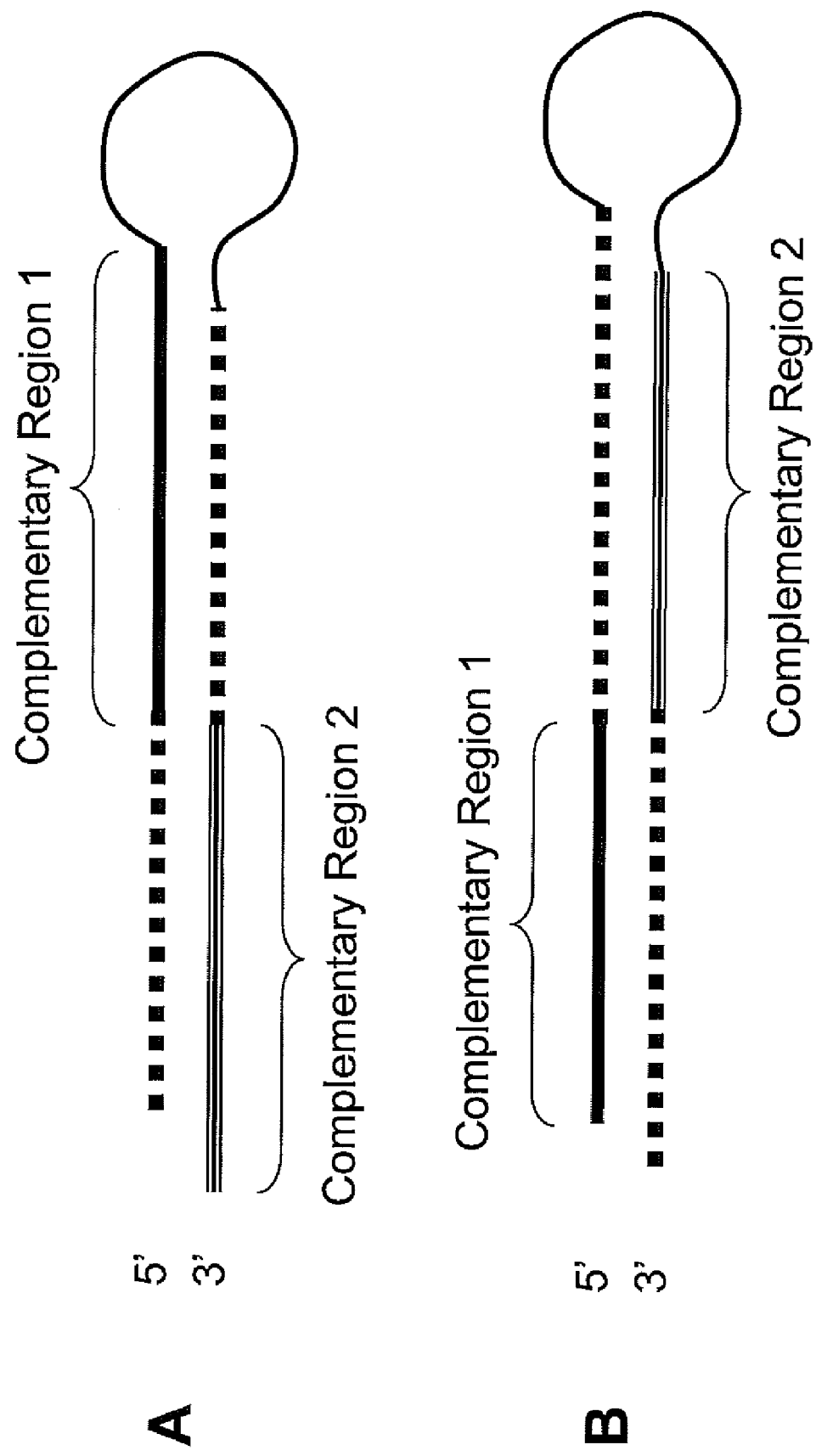
Figure 17: Examples of hairpin multifunctional siNA constructs with distinct complementary regions

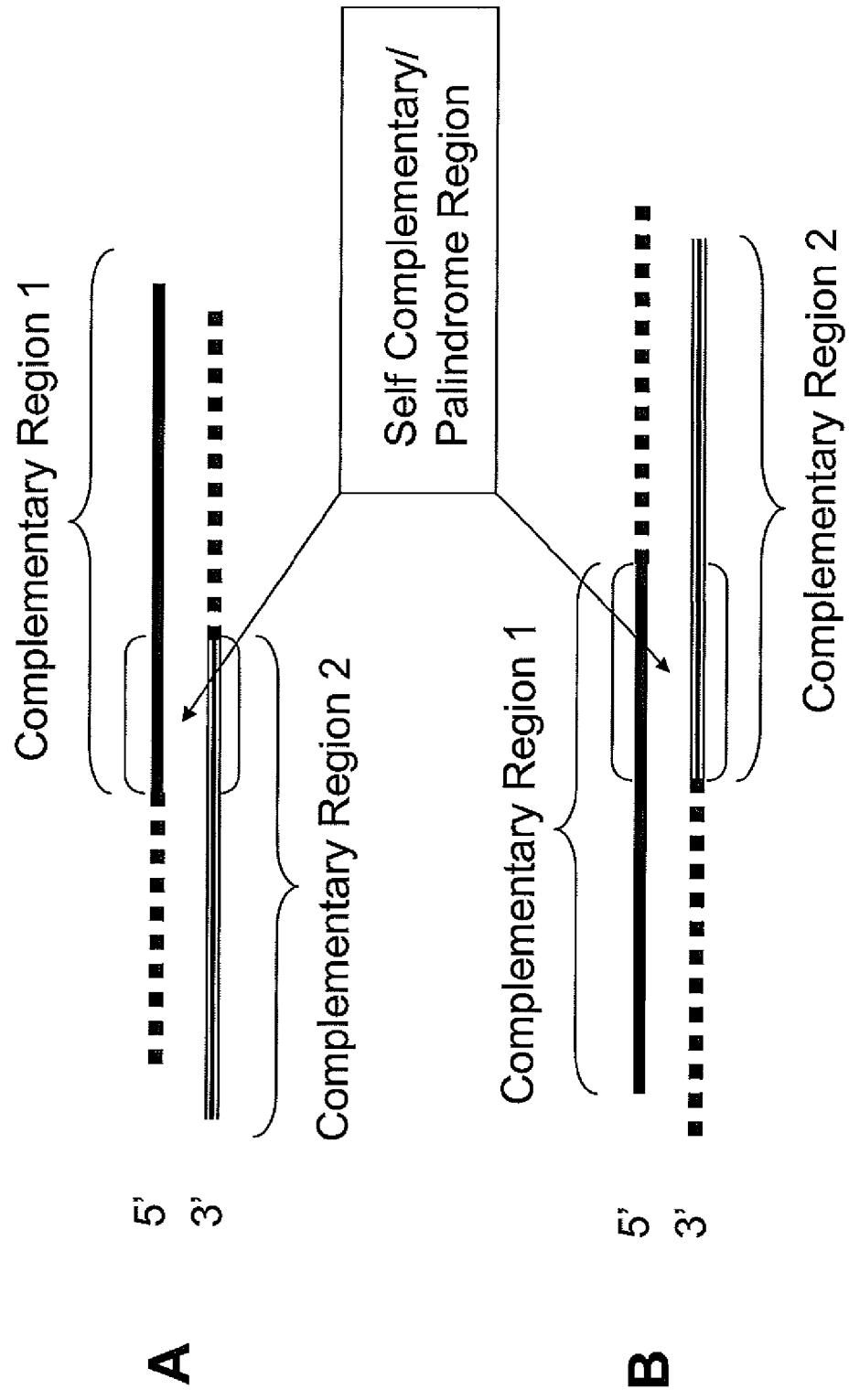
Figure 18: Examples of double stranded multifunctional siNA constructs with distinct complementary regions and a self complementary/palindrome region

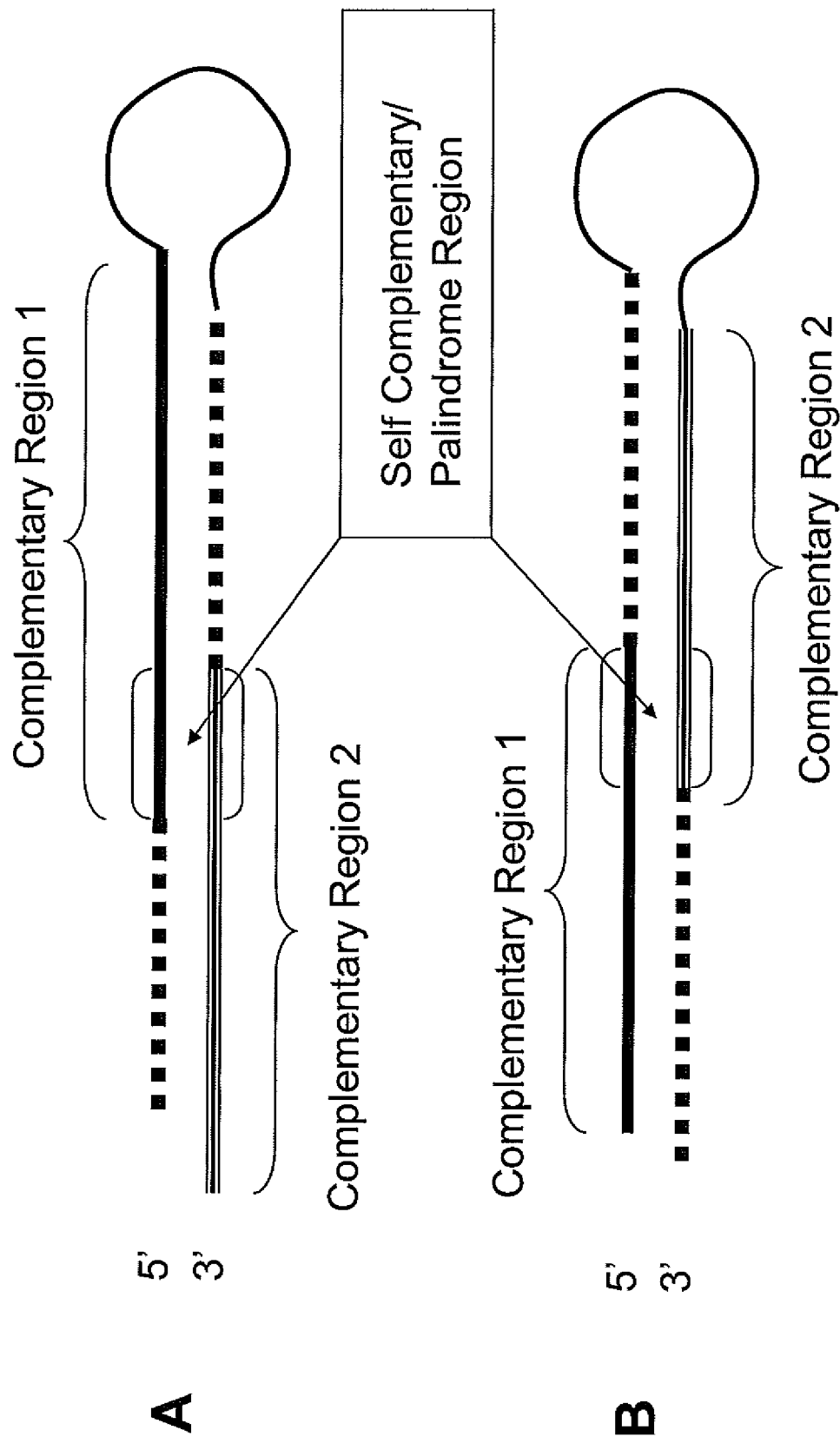
Figure 19: Examples of hairpin multifunctional siNA constructs with distinct complementary regions and a self complementary/palindrome region

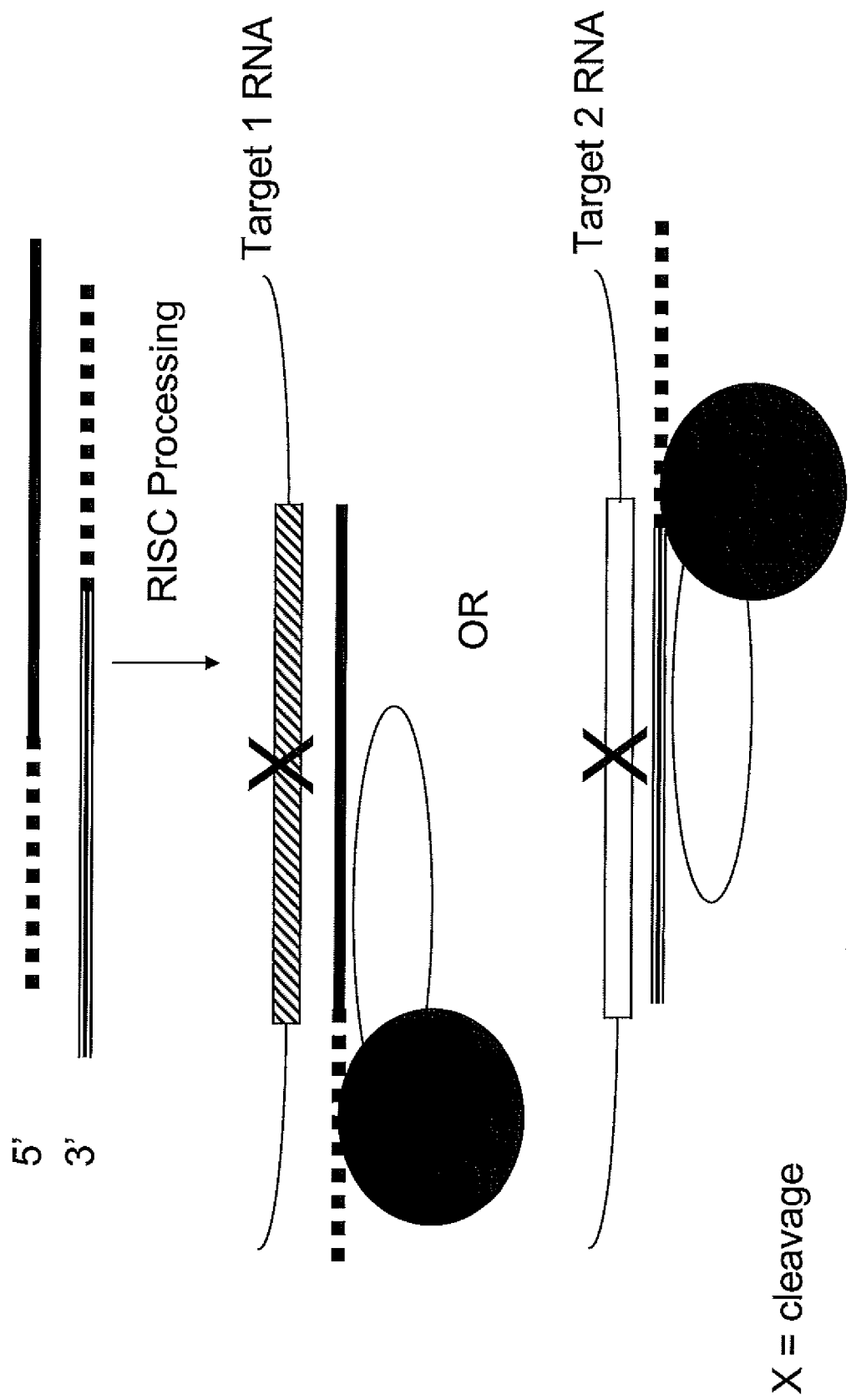

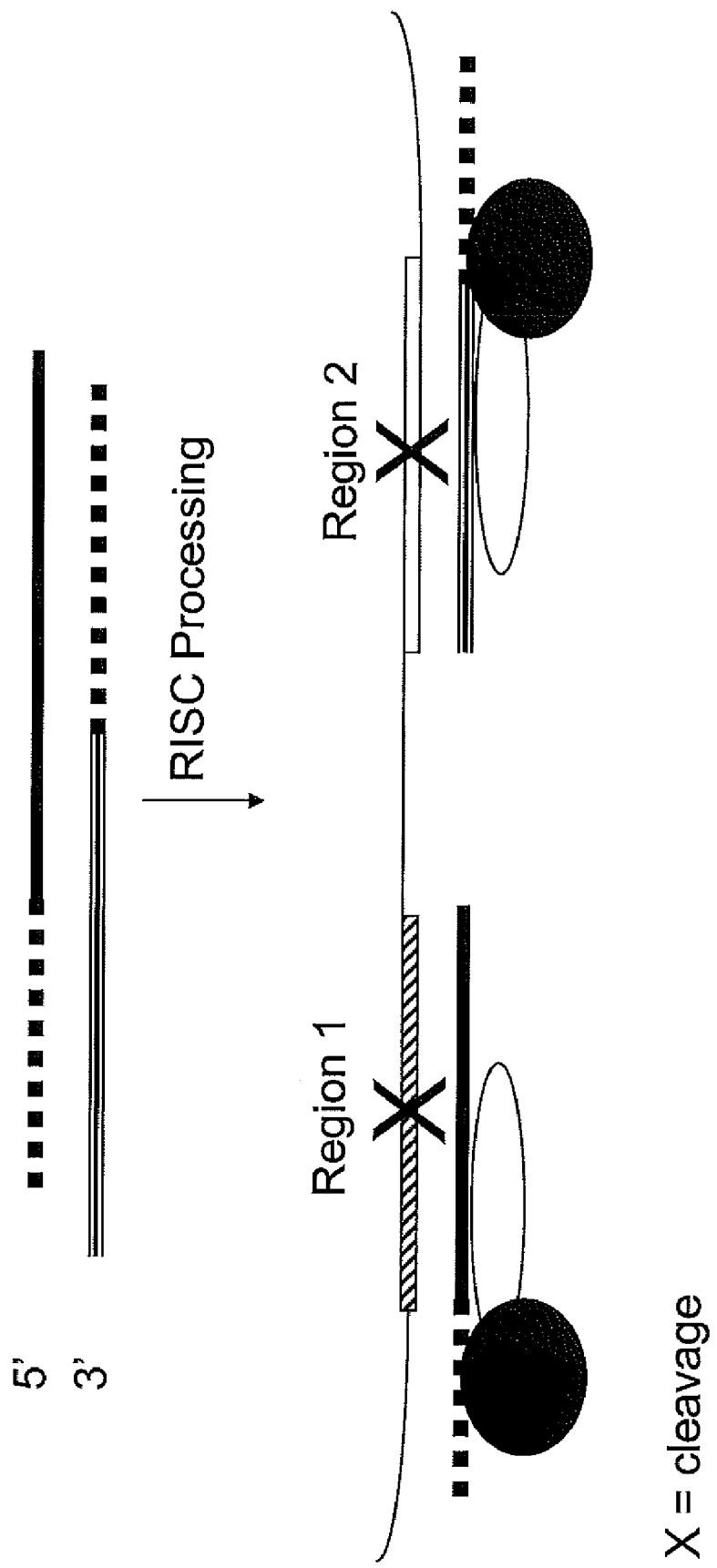
Figure 21: Example of multifunctional siNA targeting two regions within the same target nucleic acid sequence

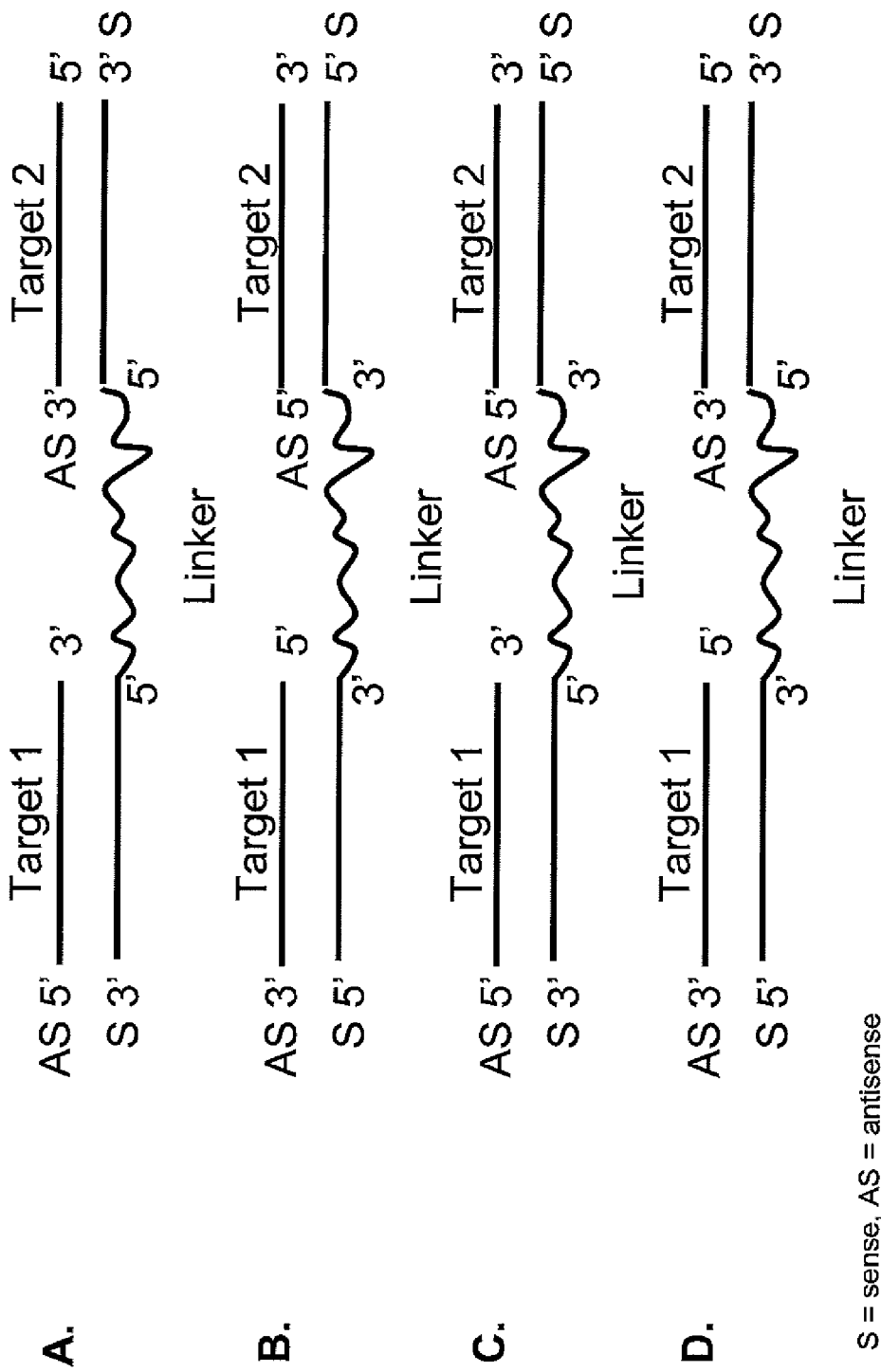
*Figure 22: Tethered Multifunctional siNA design*

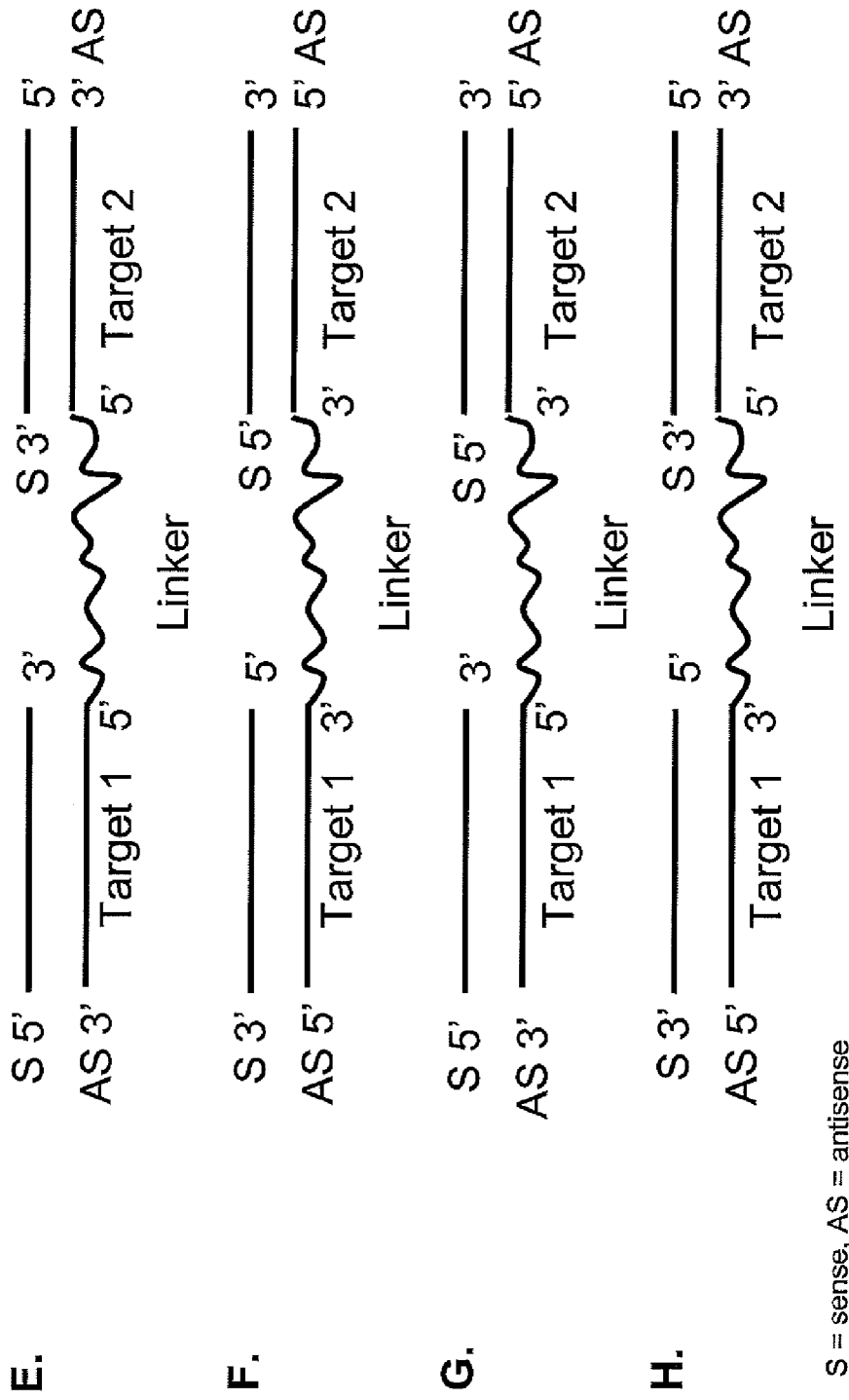
Figure 22: Tethered Multifunctional siNA design

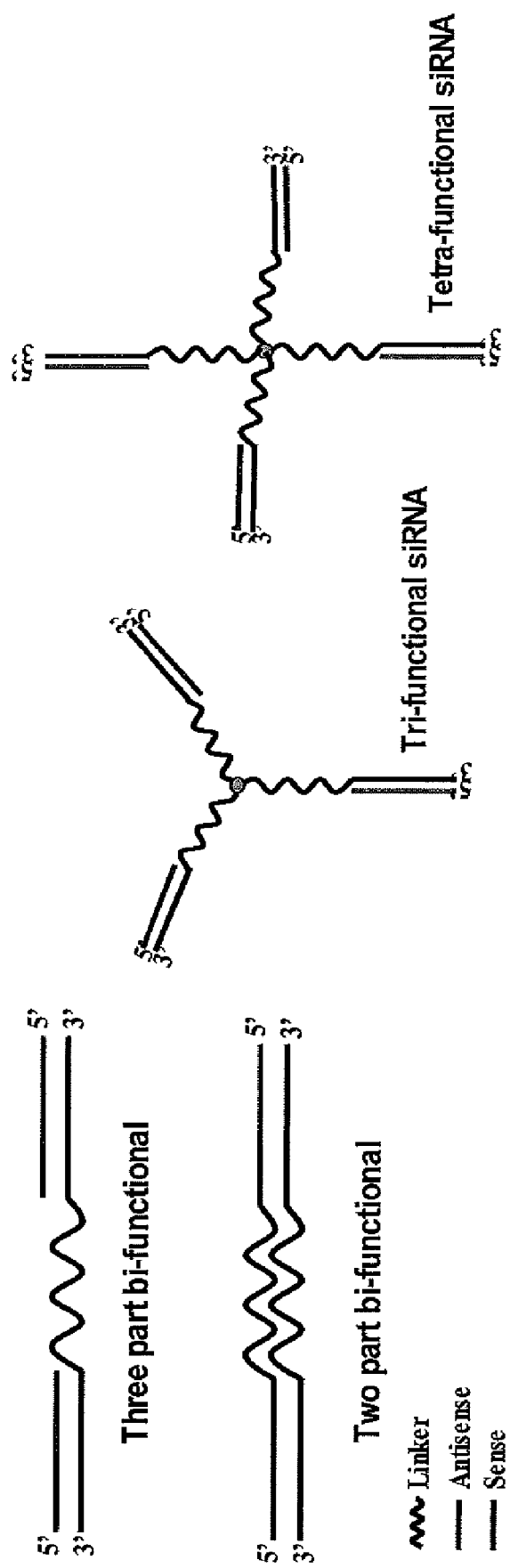
Figure 23: Dendrimer Multifunctional siNA designs

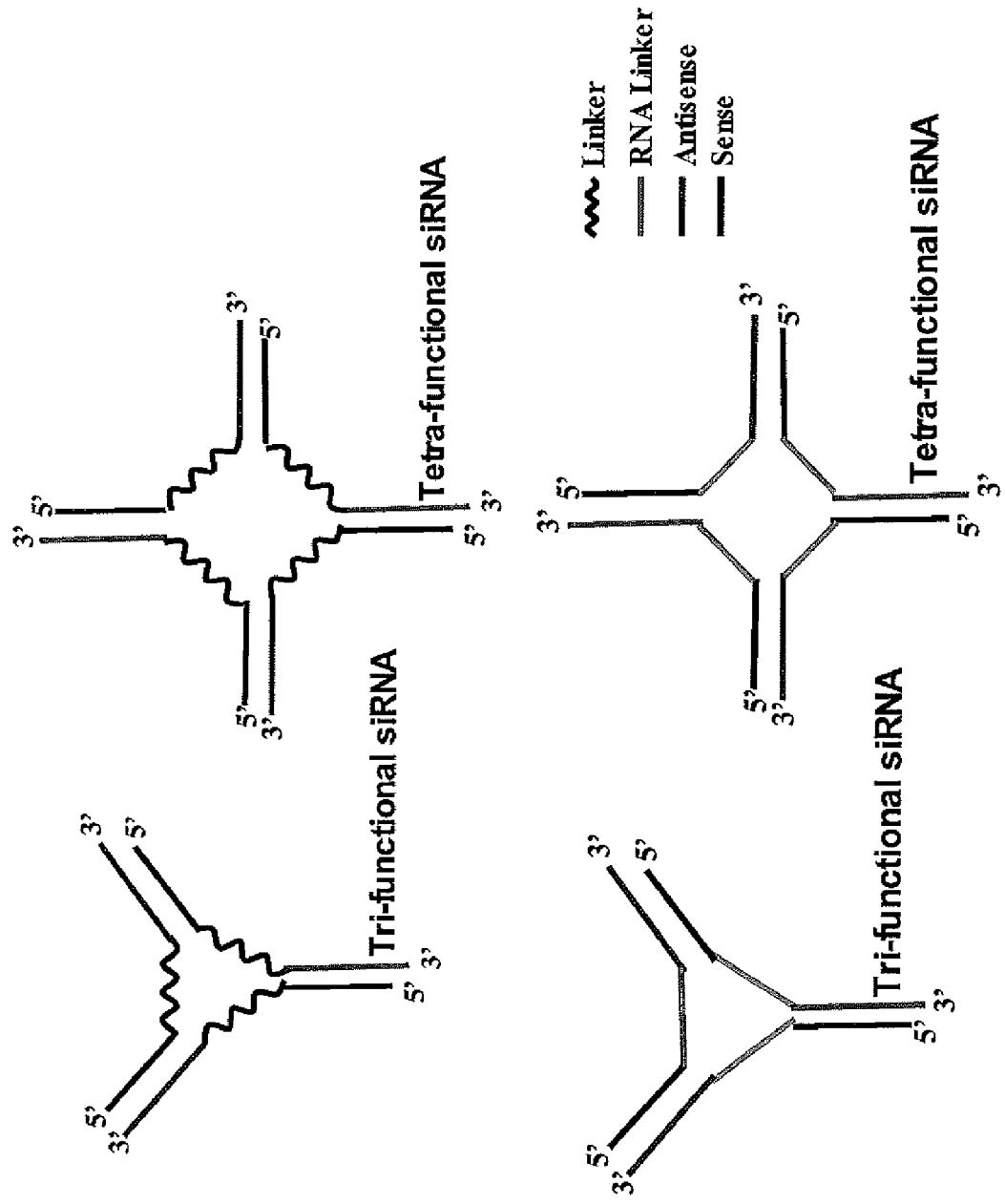
Figure 24: Supramolecular Multifunctional siNA designs

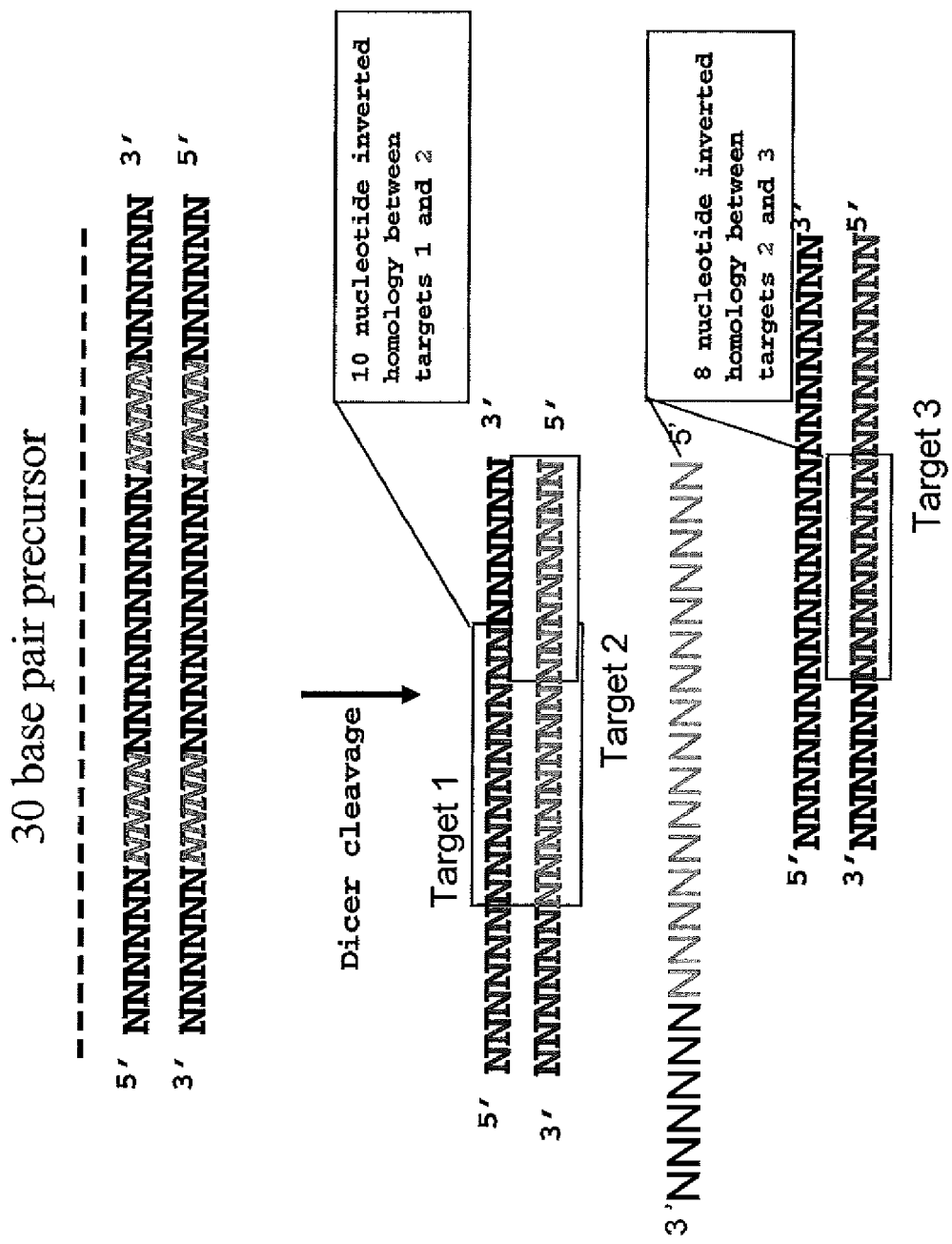
Figure 25: Dicer enabled multifunctional siNA design

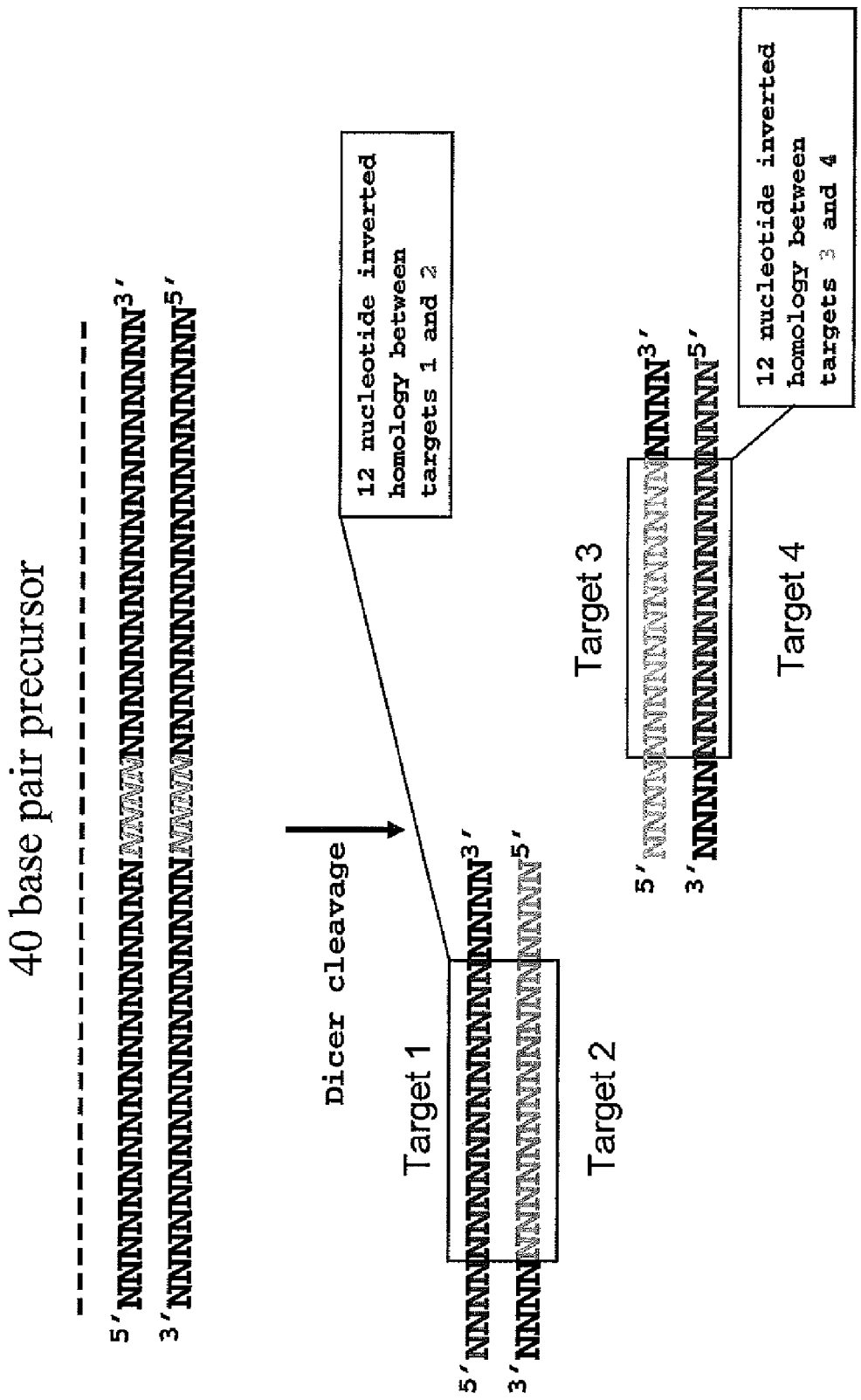

*Figure 27: Additional Multifunctional siNA designs*
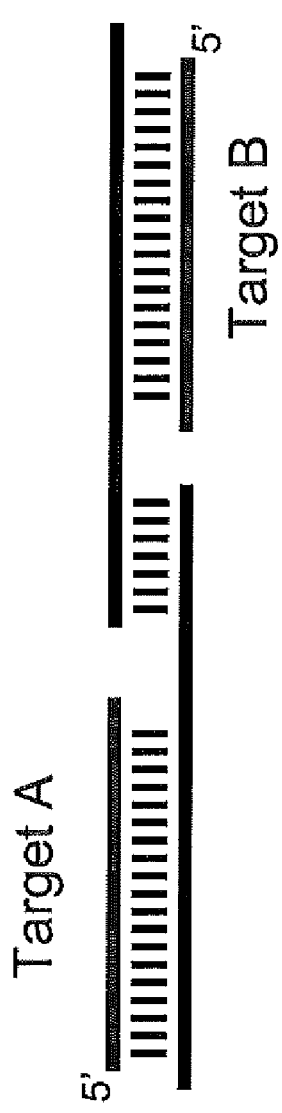
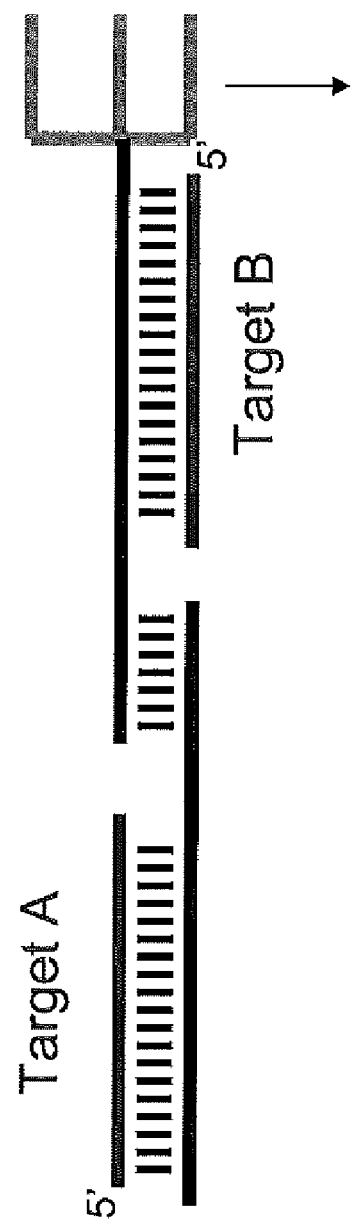
Targeting Ligand/branched Ligand e.g. Cholesterol, N-acetyl Galactosamine, Lipid, Peptide, RGD etc.

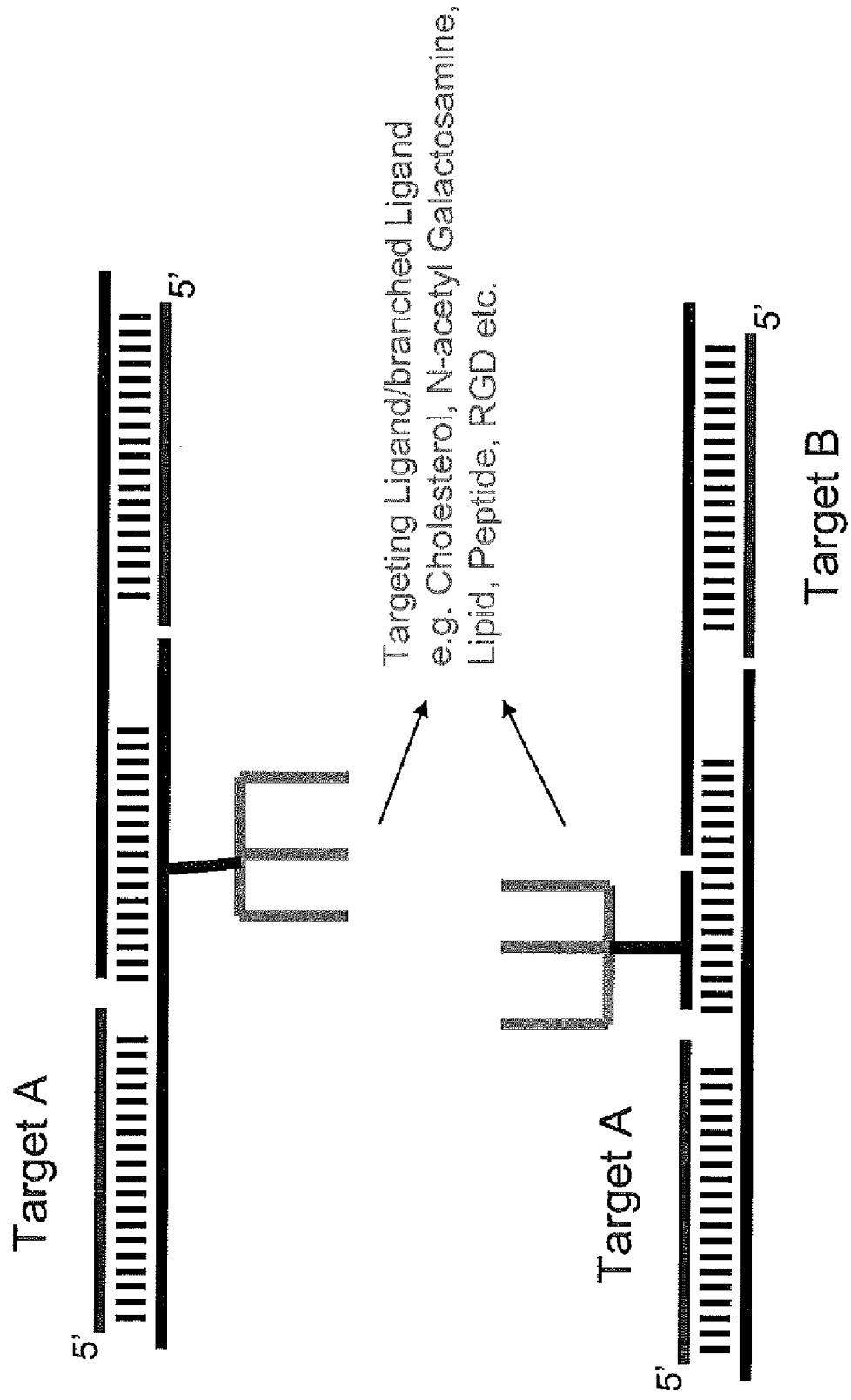
Figure 28: Additional Multifunctional siNA designs

*Figure 29: Cholesterol Conjugate Approach*
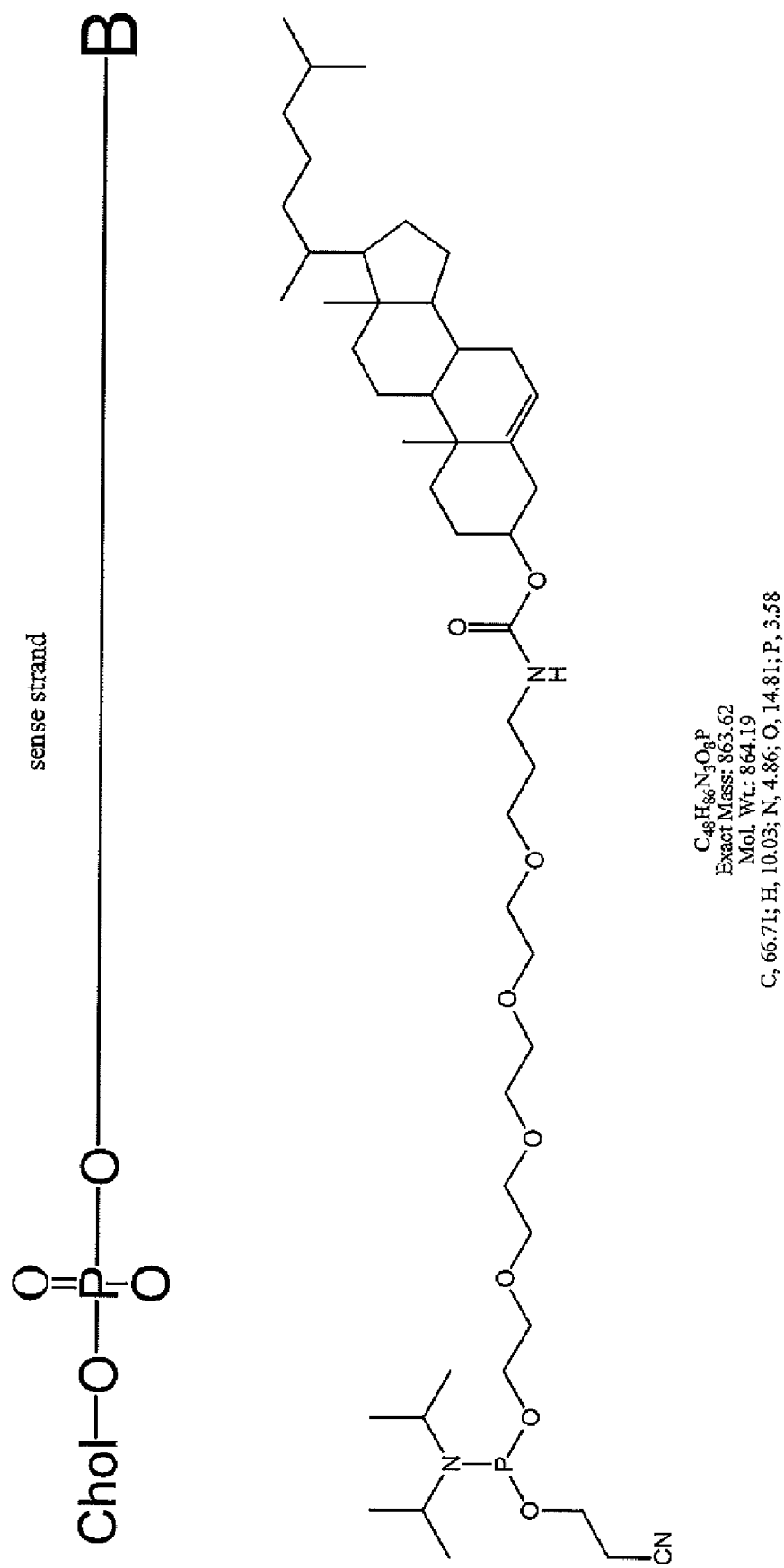

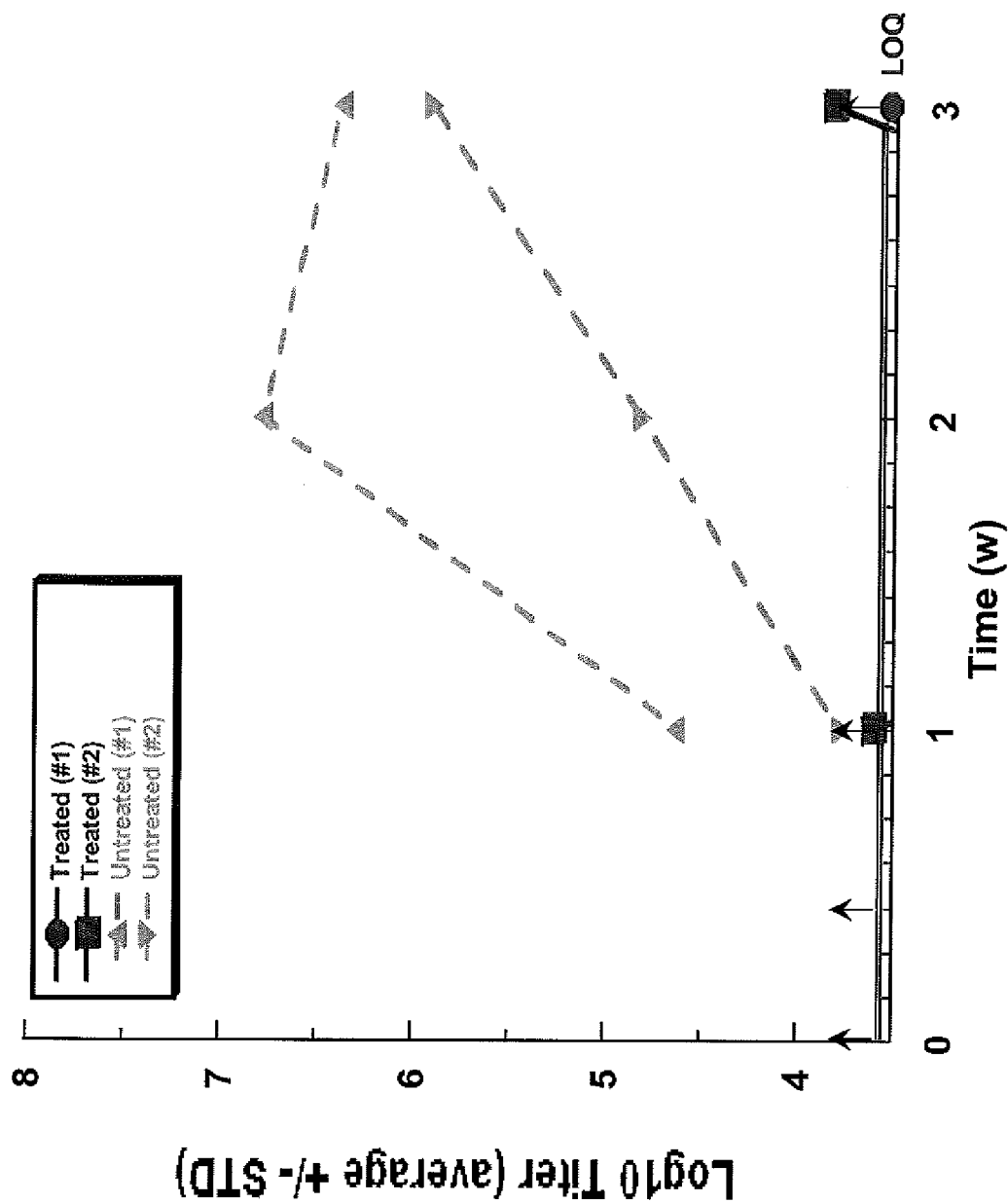

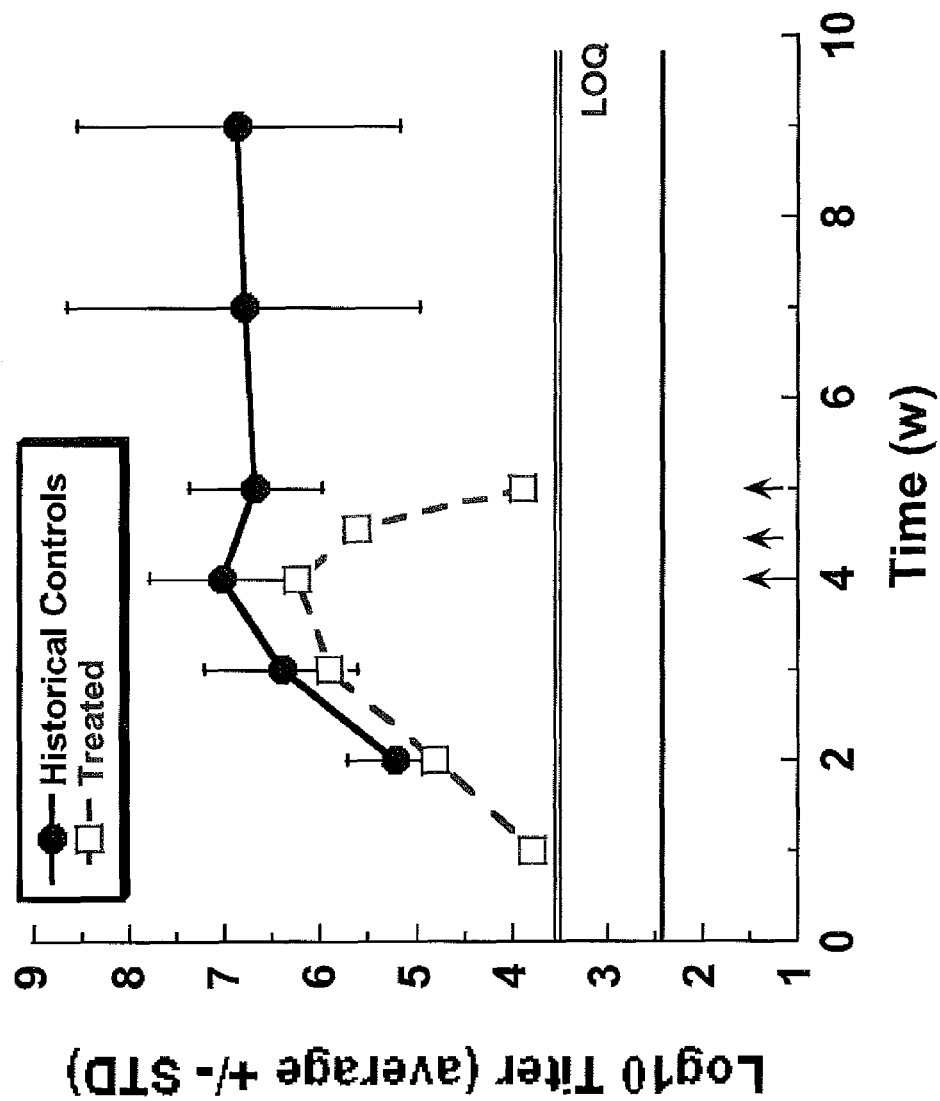
Figure 31: HCV/GBV-B Marmoset Study: Treatment of Established Infection

RNA INTERFERENCE MEDIATED INHIBITION OF HEPATITIS C VIRUS (HCV) EXPRESSION USING SHORT INTERFERING NUCLEIC ACID (SINA)

This application is a continuation-in-part of U.S. application Ser. No. 12/158,276, filed Jun. 19, 2008, now abandoned, which is a U.S. national application under 35 U.S.C. §371 (c) of International Application No. PCT/US06/062252, filed Dec. 18, 2006, which is a continuation-in-part of U.S. patent application Ser. No. 11/510,872 filed Aug. 25, 2006, which is a continuation-in-part of U.S. patent application Ser. No. 11/311,826, filed Dec. 19, 2005, which is a continuation-in-part of U.S. patent application Ser. No. 10/942,560, filed Sep. 15, 2004, which is a continuation-in-part of U.S. patent application Ser. No. 10/667,271, filed Sep. 16, 2003, which is a continuation-in-part of International Patent Application No. PCT/US03/05043, filed Feb. 20, 2003, which is a continuation-in-part of PCT/US02/09187, filed Mar. 26, 2002 and claims the benefit of U.S. Ser. No. 60/401,104, filed Aug. 5, 2002. The parent U.S. application Ser. No. 12/158,276 is also continuation-in-part of International Patent Application No. PCT/US06/32168, filed Aug. 17, 2006, which is a continuation-in-part of U.S. patent application Ser. No. 11/299,254, filed Dec. 8, 2005, which is a continuation-in-part of U.S. patent application Ser. No. 11/234,730, filed Sep. 23, 2005, which is a continuation-in-part of U.S. patent application Ser. No. 11/205,646, filed Aug. 17, 2005, which is a continuation-in-part of U.S. patent application Ser. No. 11/098,303, filed Apr. 4, 2005, which is a continuation-in-part of U.S. patent application Ser. No. 10/923,536, filed Aug. 20, 2004, which is a continuation-in-part of International Patent Application No. PCT/US04/16390, filed May 24, 2004, which is a continuation-in-part of U.S. patent application Ser. No. 10/826,966, filed Apr. 16, 2004 (now abandoned), which is continuation-in-part of U.S. patent application Ser. No. 10/757,803, filed Jan. 14, 2004, which is a continuation-in-part of U.S. patent application Ser. No. 10/720,448, filed Nov. 24, 2003, which is a continuation-in-part of U.S. patent application Ser. No. 10/693,059, filed Oct. 23, 2003, which is a continuation-in-part of U.S. patent application Ser. No. 10/444,853, filed May 23, 2003, which is a continuation-in-part of International Patent Application No. PCT/US03/05346, filed Feb. 20, 2003, and a continuation-in-part of International Patent Application No. PCT/US03/05028, filed Feb. 20, 2003, both of which claim the benefit of U.S. Provisional Application No. 60/358,580 filed Feb. 20, 2002, U.S. Provisional Application No. 60/363,124 filed Mar. 11, 2002, U.S. Provisional Application No. 60/386,782 filed Jun. 6, 2002, U.S. Provisional Application No. 60/406,784 filed Aug. 29, 2002, U.S. Provisional Application No. 60/408,378 filed Sep. 5, 2002, U.S. Provisional Application No. 60/409,293 filed Sep. 9, 2002, and U.S. Provisional Application No. 60/440,129 filed Jan. 15, 2003. The parent U.S. application Ser. No. 12/158,276 is also a continuation-in-part of International Patent Application No. PCT/US05/04270, filed Feb. 9, 2005 which claims the benefit of U.S. Provisional Application No. 60/543,480, filed Feb. 10, 2004. The parent U.S. application Ser. No. 12/158,276 is also a continuation-in-part of U.S. patent application Ser. No. 11/353,630, filed Feb. 14, 2006, which claims the benefit of U.S. Provisional Patent Application No. 60/652,787 filed Feb. 14, 2005, U.S. Provisional Patent Application No. 60/678,531 filed May 6, 2005, U.S. Provisional Patent Application No. 60/703,946, filed Jul. 29, 2005, and U.S. Provisional Patent Application No. 60/737,024, filed Nov. 15, 2005. The instant application claims the benefit of all the listed applications, which are hereby incorporated by reference herein in their entireties, including the drawings.

SEQUENCE LISTING

The sequence listing submitted via EFS, in compliance with 37 CFR §1.52(e)(5), is incorporated herein by reference. The sequence listing text file submitted via EFS contains the file "SequenceListing39USCNT2," created on Jul. 13, 2009, which is 1,032,192 bytes in size.

FIELD OF THE INVENTION

The present invention relates to compounds, compositions, and methods for the study, diagnosis, and treatment of traits, diseases and conditions that respond to the modulation of hepatitis C virus (HCV) gene expression and/or activity. The present invention is also directed to compounds, compositions, and methods relating to traits, diseases and conditions that respond to the modulation of expression and/or activity of genes involved in hepatitis C virus (HCV) gene expression pathways or other cellular processes that mediate the maintenance or development of such traits, diseases and conditions. Specifically, the invention relates to double stranded nucleic acid molecules including small nucleic acid molecules, such as short interfering nucleic acid (siNA), short interfering RNA (siRNA), double-stranded RNA (dsRNA), micro-RNA (miRNA), and short hairpin RNA (shRNA) molecules capable of mediating or that mediate RNA interference (RNAi) against hepatitis C virus (HCV) gene expression, including cocktails of such small nucleic acid molecules and lipid nanoparticle (LNP) formulations of such small nucleic acid molecules. The present invention also relates to small nucleic acid molecules, such as siNA, siRNA, and others that can inhibit the function of endogenous RNA molecules, such as endogenous micro-RNA (miRNA) (e.g, miRNA inhibitors) or endogenous short interfering RNA (siRNA), (e.g., siRNA inhibitors) or that can inhibit the function of RISC (e.g., RISC inhibitors), to modulate gene expression by interfering with the regulatory function of such endogenous RNAs or proteins associated with such endogenous RNAs (e.g., RISC), including cocktails of such small nucleic acid molecules and lipid nanoparticle (LNP) formulations of such small nucleic acid molecules. Such small nucleic acid molecules are useful, for example, in providing compositions to prevent, inhibit, or reduce HCV infection, liver failure, hepatocellular carcinoma, cirrhosis, and/or other disease states associated with HCV infection in a subject or organism.

BACKGROUND OF THE INVENTION

The following is a discussion of relevant art pertaining to RNAi. The discussion is provided only for understanding of the invention that follows. The summary is not an admission that any of the work described below is prior art to the claimed invention.

RNA interference refers to the process of sequence-specific post-transcriptional gene silencing in animals mediated by short interfering RNAs (siRNAs) (Zamore et al., 2000, Cell, 101, 25-33; Fire et al., 1998, Nature, 391, 806; Hamilton et al., 1999, Science, 286, 950-951; Lin et al., 1999, Nature, 402, 128-129; Sharp, 1999, Genes & Dev., 13:139-141; and Strauss, 1999, Science, 286, 886). The corresponding process in plants (Heifetz et al., International PCT Publication No. WO 99/61631) is commonly referred to as post-transcriptional gene silencing or RNA silencing and is also referred to as quelling in fungi. The process of post-transcriptional gene silencing is thought to be an evolutionarily-conserved cellular defense mechanism used to prevent the expression of foreign genes and is commonly shared by diverse flora and phyla (Fire et al., 1999, *Trends Genet.*, 15, 358). Such protection from foreign gene expression may have evolved in response to the production of double-stranded RNAs (dsRNAs) derived from viral infection or from the random integration of transposon elements into a host genome via a cellular response that specifically destroys homologous single-stranded RNA or viral genomic RNA. The presence of dsRNA in cells triggers the RNAi response through a mechanism that has yet to be fully characterized. This mechanism appears to be different from other known mechanisms involving double stranded RNA-specific ribonucleases, such as the interferon response that results from dsRNA-mediated activation of protein kinase PKR and 2',5'-oligoadenylate synthetase resulting in non-specific cleavage of mRNA by ribonuclease L (see for example U.S. Pat. Nos. 6,107,094; 5,898,031; Clemens et al., 1997, *J. Interferon & Cytokine Res.*, 17, 503-524; Adah et al., 2001, *Curr. Med. Chem.*, 8, 1189).

The presence of long dsRNAs in cells stimulates the activity of a ribonuclease III enzyme referred to as dicer (Bass, 2000, Cell, 101, 235; Zamore et al., 2000, Cell, 101, 25-33; Hammond et al., 2000, Nature, 404, 293). Dicer is involved in the processing of the dsRNA into short pieces of dsRNA known as short interfering RNAs (siRNAs) (Zamore et al., 2000, Cell, 101, 25-33; Bass, 2000, Cell, 101, 235; Berstein et al., 2001, *Nature*, 409, 363). Short interfering RNAs derived from dicer activity are typically about 21 to about 23 nucleotides in length and comprise about 19 base pair duplexes (Zamore et al., 2000, *Cell*, 101, 25-33; Elbashir et al., 2001, *Genes Dev.*, 15, 188). Dicer has also been implicated in the excision of 21- and 22-nucleotide small temporal RNAs (stRNAs) from precursor RNA of conserved structure that are implicated in translational control (Hutvagner et al., 2001, *Science*, 293, 834). The RNAi response also features an endonuclease complex, commonly referred to as an RNA-induced silencing complex (RISC), which mediates cleavage of single-stranded RNA having sequence complementary to the antisense strand of the siRNA duplex. Cleavage of the target RNA takes place in the middle of the region complementary to the antisense strand of the siRNA duplex (Elbashir et al., 2001, *Genes Dev.*, 15, 188).

RNAi has been studied in a variety of systems. Fire et al., 1998, Nature, 391, 806, were the first to observe RNAi in *C. elegans*. Bahramian and Zarbl, 1999, *Molecular and Cellular Biology*, 19, 274-283 and Wianny and Goetz, 1999, *Nature Cell Biol.*, 2, 70, describe RNAi mediated by dsRNA in mammalian systems. Hammond et al., 2000, *Nature*, 404, 293, describe RNAi in *Drosophila* cells transfected with dsRNA. Elbashir et al., 2001, *Nature*, 411, 494 and Tuschl et al., International PCT Publication No. WO 01/75164, describe RNAi induced by introduction of duplexes of synthetic 21-nucleotide RNAs in cultured mammalian cells including human embryonic kidney and HeLa cells. Recent work in *Drosophila* embryonic lysates (Elbashir et al., 2001, *EMBO J.*, 20, 6877 and Tuschl et al., International PCT Publication No. WO 01/75164) has revealed certain requirements for siRNA length, structure, chemical composition, and sequence that are essential to mediate efficient RNAi activity. These studies have shown that 21-nucleotide siRNA duplexes are most active when containing 3'-terminal dinucleotide overhangs. Furthermore, complete substitution of one or both siRNA strands with 2'-deoxy (2'-H) or 2'-O-methyl nucleotides abolishes RNAi activity, whereas substitution of the 3'-terminal siRNA overhang nucleotides with 2'-deoxy nucleotides (2'-H) was shown to be tolerated. Single mismatch sequences in the center of the siRNA duplex were also shown to abolish RNAi activity. In addition, these studies also indicate that the position of the cleavage site in the target RNA is defined by the 5'-end of the siRNA guide sequence rather than the 3'-end of the guide sequence (Elbashir et al., 2001, *EMBO J.*, 20, 6877). Other studies have indicated that a 5'-phosphate on the target-complementary strand of a siRNA duplex is required for siRNA activity and that ATP is utilized to maintain the 5'-phosphate moiety on the siRNA (Nykanen et al., 2001, *Cell*, 107, 309).

Studies have shown that replacing the 3'-terminal nucleotide overhanging segments of a 21-mer siRNA duplex having two-nucleotide 3'-overhangs with deoxyribonucleotides does not have an adverse effect on RNAi activity. Replacing up to four nucleotides on each end of the siRNA with deoxyribonucleotides has been reported to be well tolerated, whereas complete substitution with deoxyribonucleotides results in no RNAi activity (Elbashir et al., 2001, *EMBO J.*, 20, 6877 and Tuschl et al., International PCT Publication No. WO 01/75164). In addition, Elbashir et al., supra, also report that substitution of siRNA with 2'-O-methyl nucleotides completely abolishes RNAi activity. Li et al., International PCT Publication No. WO 00/44914, and Beach et al., International PCT Publication No. WO 01/68836 preliminarily suggest that siRNA may include modifications to either the phosphate-sugar backbone or the nucleoside to include at least one of a nitrogen or sulfur heteroatom, however, neither application postulates to what extent such modifications would be tolerated in siRNA molecules, nor provides any further guidance or examples of such modified siRNA. Kreutzer et al., Canadian Patent Application No. 2,359,180, also describe certain chemical modifications for use in dsRNA constructs in order to counteract activation of double-stranded RNA-dependent protein kinase PKR, specifically 2'-amino or 2'-O-methyl nucleotides, and nucleotides containing a 2'-O or 4'-C methylene bridge. However, Kreutzer et al. similarly fails to provide examples or guidance as to what extent these modifications would be tolerated in dsRNA molecules.

Parrish et al., 2000, *Molecular Cell*, 6, 1077-1087, tested certain chemical modifications targeting the unc-22 gene in *C. elegans* using long (>25 nt) siRNA transcripts. The authors describe the introduction of thiophosphate residues into these siRNA transcripts by incorporating thiophosphate nucleotide analogs with T7 and T3 RNA polymerase and observed that RNAs with two phosphorothioate modified bases also had substantial decreases in effectiveness as RNAi. Further, Parrish et al. reported that phosphorothioate modification of more than two residues greatly destabilized the RNAs in vitro such that interference activities could not be assayed. Id. at 1081. The authors also tested certain modifications at the 2'-position of the nucleotide sugar in the long siRNA transcripts and found that substituting deoxynucleotides for ribonucleotides produced a substantial decrease in interference activity, especially in the case of Uridine to Thymidine and/or Cytidine to deoxy-Cytidine substitutions. Id. In addition, the authors tested certain base modifications, including substituting, in sense and antisense strands of the siRNA, 4-thiouracil, 5-bromouracil, 5-iodouracil, and 3-(aminoallyl)uracil for uracil, and inosine for guanosine. Whereas 4-thiouracil and 5-bromouracil substitution appeared to be tolerated, Parrish reported that inosine produced a substantial decrease in interference activity when incorporated in either strand. Parrish also reported that incorporation of 5-iodouracil and 3-(aminoallyl)uracil in the antisense strand resulted in a substantial decrease in RNAi activity as well.

The use of longer dsRNA has been described. For example, Beach et al., International PCT Publication No. WO 01/68836, describes specific methods for attenuating gene expression using endogenously-derived dsRNA. Tuschl et al., International PCT Publication No. WO 01/75164, describe a *Drosophila* in vitro RNAi system and the use of specific siRNA molecules for certain functional genomic and certain therapeutic applications; although Tuschl, 2001, *Chem. Biochem.*, 2, 239-245, doubts that RNAi can be used to cure genetic diseases or viral infection due to the danger of activating interferon response. Li et al., International PCT Publication No. WO 00/44914, describe the use of specific long (141 bp-488 bp) enzymatically synthesized or vector expressed dsRNAs for attenuating the expression of certain target genes. Zernicka-Goetz et al., International PCT Publication No. WO 01/36646, describe certain methods for inhibiting the expression of particular genes in mammalian cells using certain long (550 bp-714 bp), enzymatically synthesized or vector expressed dsRNA molecules. Fire et al., International PCT Publication No. WO 99/32619, describe particular methods for introducing certain long dsRNA molecules into cells for use in inhibiting gene expression in nematodes. Plaetinck et al., International PCT Publication No. WO 00/01846, describe certain methods for identifying specific genes responsible for conferring a particular phenotype in a cell using specific long dsRNA molecules. Mello et al., International PCT Publication No. WO 01/29058, describe the identification of specific genes involved in dsRNA-mediated RNAi. Pachuck et al., International PCT Publication No. WO 00/63364, describe certain long (at least 200 nucleotide) dsRNA constructs. Deschamps Depaillette et al., International PCT Publication No. WO 99/07409, describe specific compositions consisting of particular dsRNA molecules combined with certain anti-viral agents. Waterhouse et al., International PCT Publication No. 99/53050 and 1998, *PNAS*, 95, 13959-13964, describe certain methods for decreasing the phenotypic expression of a nucleic acid in plant cells using certain dsRNAs. Driscoll et al., International PCT Publication No. WO 01/49844, describe specific DNA expression constructs for use in facilitating gene silencing in targeted organisms.

Others have reported on various RNAi and gene-silencing systems. For example, Parrish et al., 2000, *Molecular Cell*, 6, 1077-1087, describe specific chemically-modified dsRNA constructs targeting the unc-22 gene of *C. elegans*. Grossniklaus, International PCT Publication No. WO 01/38551, describes certain methods for regulating polycomb gene expression in plants using certain dsRNAs. Churikov et al., International PCT Publication No. WO 01/42443, describe certain methods for modifying genetic characteristics of an organism using certain dsRNAs. Cogoni et al, International PCT Publication No. WO 01/53475, describe certain methods for isolating a *Neurospora* silencing gene and uses thereof. Reed et al., International PCT Publication No. WO 01/68836, describe certain methods for gene silencing in plants. Honer et al., International PCT Publication No. WO 01/70944, describe certain methods of drug screening using transgenic nematodes as Parkinson's Disease models using certain dsRNAs. Deak et al., International PCT Publication No. WO 01/72774, describe certain *Drosophila*-derived gene products that may be related to RNAi in *Drosophila*. Arndt et al., International PCT Publication No. WO 01/92513 describe certain methods for mediating gene suppression by using factors that enhance RNAi. Tuschl et al., International PCT Publication No. WO 02/44321, describe certain synthetic siRNA constructs. Pachuk et al., International PCT Publication No. WO 00/63364, and Satishchandran et al., International PCT Publication No. WO 01/04313, describe certain methods and compositions for inhibiting the function of certain polynucleotide sequences using certain long (over 250 bp), vector expressed dsRNAs. Echeverri et al., International PCT Publication No. WO 02/38805, describe certain *C. elegans* genes identified via RNAi. Kreutzer et al., International PCT Publications Nos. WO 02/055692, WO 02/055693, and EP 1144623 B1 describes certain methods for inhibiting gene expression using dsRNA. Graham et al., International PCT Publications Nos. WO 99/49029 and WO 01/70949, and AU 4037501 describe certain vector expressed siRNA molecules. Fire et al., U.S. Pat. No. 6,506,559, describe certain methods for inhibiting gene expression in vitro using certain long dsRNA (299 bp-1033 bp) constructs that mediate RNAi. Martinez et al., 2002, *Cell*, 110, 563-574, describe certain single stranded siRNA constructs, including certain 5'-phosphorylated single stranded siRNAs that mediate RNA interference in Hela cells. Harborth et al., 2003, *Antisense & Nucleic Acid Drug Development*, 13, 83-105, describe certain chemically and structurally modified siRNA molecules. Chiu and Rana, 2003, *RNA*, 9, 1034-1048, describe certain chemically and structurally modified siRNA molecules. Woolf et al., International PCT Publication Nos. WO 03/064626 and WO 03/064625 describe certain chemically modified dsRNA constructs. Hornung et al., 2005, *Nature Medicine*, 11, 263-270, describe the sequence-specific potent induction of IFN-alpha by short interfering RNA in plasmacytoid dendritic cells through TLR7. Judge et al., 2005, Nature Biotechnology, Published online: 20 Mar. 2005, describe the sequence-dependent stimulation of the mammalian innate immune response by synthetic siRNA. Yuki et al., International PCT Publication Nos. WO 05/049821 and WO 04/048566, describe certain methods for designing short interfering RNA sequences and certain short interfering RNA sequences with optimized activity. Saigo et al., US Patent Application Publication No. US20040539332, describe certain methods of designing oligo- or polynucleotide sequences, including short interfering RNA sequences, for achieving RNA interference. Tei et al., International PCT Publication No. WO 03/044188, describe certain methods for inhibiting expression of a target gene, which comprises transfecting a cell, tissue, or individual organism with a double-stranded polynucleotide comprising DNA and RNA having a substantially identical nucleotide sequence with at least a partial nucleotide sequence of the target gene.

Mattick, 2005, *Science*, 309, 1527-1528; Claverie, 2005, *Science*, 309, 1529-1530; Sethupathy et al., 2006, *RNA*, 12, 192-197; and Czech, 2006 *NEJM*, 354, 11: 1194-1195; Hutvagner et al., US 20050227256, and Tuschl et al., US 20050182005, all describe antisense molecules that can inhibit miRNA function via steric blocking and are all incorporated by reference herein in their entirety.

McCaffrey et al., 2002, *Nature*, 418, 38-39, describes the use of certain siRNA constructs targeting a chimeric HCV NS5B protein/luciferase transcript in mice.

Randall et al., 2003, *PNAS USA*, 100, 235-240, describe certain siRNA constructs targeting HCV RNA in Huh7 hepatoma cell lines.

SUMMARY OF THE INVENTION

This invention relates to compounds, compositions, and methods useful for modulating the expression of genes, such as those genes associated with the development or maintenance of HCV infection, liver failure, hepatocellular carcinoma, cirrhosis, and/or other disease states associated with HCV infection, by RNA interference (RNAi) using short interfering nucleic acid (siNA) molecules. This invention further relates to compounds, compositions, and methods useful for modulating the expression and activity of one or more genes involved in pathways of HCV gene expression and/or activity by RNA interference (RNAi) using small nucleic acid molecules. In particular, the instant invention features small nucleic acid molecules, such as short interfering nucleic acid (siNA), short interfering RNA (siRNA), double-stranded RNA (dsRNA), micro-RNA (miRNA), and short hairpin RNA (shRNA) molecules and methods used to modulate the expression of HCV genes and/or other genes (e.g., cellular or host genes) involved in pathways of HCV gene expression and/or infection.

The instant invention also relates to small nucleic acid molecules, such as siNA, siRNA, and others that can inhibit the function of endogenous RNA molecules, such as endogenous micro-RNA (miRNA) (e.g, miRNA inhibitors) or endogenous short interfering RNA (siRNA), (e.g., siRNA inhibitors) or that can inhibit the function of RISC (e.g., RISC inhibitors), to modulate gene expression by interfering with the regulatory function of such endogenous RNAs or proteins associated with such endogenous RNAs (e.g., RISC). Such molecules are collectively referred to herein as RNAi inhibitors.

A siNA or RNAi inhibitor of the invention can be unmodified or chemically-modified. A siNA or RNAi inhibitor of the instant invention can be chemically synthesized, expressed from a vector or enzymatically synthesized. The instant invention also features various chemically-modified synthetic short interfering nucleic acid (siNA) molecules capable of modulating target gene expression or activity in cells by RNA interference (RNAi). The instant invention also features various chemically-modified synthetic short nucleic acid (siNA) molecules capable of modulating RNAi activity in cells by interacting with miRNA, siRNA, or RISC, and hence down regulating or inhibiting RNA interference (RNAi), translational inhibition, or transcriptional silencing in a cell or organism. The use of chemically-modified siNA and/or RNAi inhibitors improves various properties of native siNA molecules and/or RNAi inhibitors through increased resistance to nuclease degradation in vivo and/or through improved cellular uptake. Further, contrary to earlier published studies, siNA molecules of the invention having multiple chemical modifications, including fully modified siNA, retains its RNAi activity. Therefore, Applicant teaches herein chemically modified siRNA (generally referred to herein as siNA) that retains or improves upon the activity of native siRNA. The siNA molecules of the instant invention provide useful reagents and methods for a variety of therapeutic, prophylactic, veterinary, diagnostic, target validation, genomic discovery, genetic engineering, and pharmacogenomic applications.

In one embodiment, the invention features one or more siNA molecules and/or RNAi inhibitors and methods that independently or in combination modulate the expression of HCV and HCV related host target genes encoding proteins, such as proteins that are associated with the maintenance or development of HCV infection, liver failure, hepatocellular carcinoma, and cirrhosis, such as genes encoding sequences comprising those sequences referred to by GenBank Accession Nos. shown in Table I, referred to herein generally as HCV. The description below of the various aspects and embodiments of the invention is provided with reference to exemplary hepatitis C virus (HCV) genes, generally referred to herein as HCV. However, such reference is meant to be exemplary only and the various aspects and embodiments of the invention are also directed to other genes that express alternate HCV genes, such as mutant HCV genes, splice variants of HCV genes, and genes encoding different strains of HCV, as well as cellular targets for HCV, such as those described herein and also referred to by GenBank Accession Nos. herein and in PCT/US03/05028, U.S. Provisional Patent Application No. 60/363,124, or U.S. Ser. No. 10/923,536 and U.S. Ser. No. 10/444,853, all of which are incorporated by reference herein, referred to herein generally as "target" sequences. The various aspects and embodiments are also directed to other genes involved in HCV pathways, including genes that encode cellular proteins involved in the maintenance and/or development of HCV infection, liver failure, hepatocellular carcinoma, and cirrhosis or other genes that express other proteins associated with HCV infection, such as cellular proteins that are utilized in the HCV life-cycle. Such additional genes can be analyzed for target sites using the methods described herein for HCV. Thus, the inhibition and the effects of such inhibition of the other genes can be measured as described herein. In other words, the terms "target" and "target gene" as defined herein below and recited in the described embodiments, is meant to encompass genes associated with the development and/or maintenance of HCV infection, such as genes which encode HCV polypeptides, including polypeptides of different strains of HCV, regulatory polynucleotides (e.g., miRNAs and siRNAs), mutant HCV genes, and splice variants of HCV genes, as well as cellular genes involved in HCV pathways of gene expression, replication, and/or HCV activity. Also, the term "target" as it is defined herein below and recited in the described embodiments, is meant to encompass HCV viral gene products and cellular gene products involved in HCV infection, such as those described herein. Thus, each of the embodiments described herein with reference to the term "target" are applicable to all of the virus, cellular and viral protein, peptide, polypeptide, and/or polynucleotide molecules covered by the term "HCV", as that term is defined herein. Comprehensively, such gene targets are also referred to herein generally as "target" sequences.

In one embodiment, the invention features a composition comprising two or more different siNA molecules and/or RNAi inhibitors of the invention targeting different polynucleotide targets, such as different regions of HCV RNA (e.g., siNA, duplex forming siNA, or multifunctional siNA or any combination thereof) targeting different polynucleotide targets, such as different regions of a target RNA or DNA (e.g., two different target sites such as provided herein or any combination of targets or pathway targets) or both coding and non-coding targets. Such pools of siNA molecules can provide increased therapeutic effect. two different target sites herein), different viral strains (e.g., HCV strains, or HIV and HCV, HCV and HBV etc.), or different viral and cellular targets (e.g., a HCV target and a cellular target). Such pools of siNA molecules can prevent or overcome viral resistance or otherwise provide increased therapeutic effect.

In one embodiment, the invention features siNA molecules having RNAi specificity for the HCV minus strand, for example, Genbank Accession No. HPCK1S1, Hepatitis C virus (strain HCV-1b, clone HCV-K1-S1), complete genome; Genbank Accession No. D50483, 9410 nt.

In one embodiment, the invention features a pool of two or more different siNA molecules of the invention (e.g., siNA, duplex forming siNA, or multifunctional siNA or any combination thereof) that have specificity for different HCV polynucleotide targets, such as different regions of target HCV RNA or DNA (e.g., two different target sites herein or any combination of targets or host/pathway targets) or both coding and non-coding targets, wherein the pool comprises siNA molecules targeting about 2, 3, 4, 5, 6, 7, 8, 9, 10 or more different targets.

In one embodiment, the invention features one or more siNA molecules and methods that independently or in combination modulate the expression of genes representing cellular targets for HCV infection, such as cellular receptors, cell surface molecules, cellular enzymes, cellular transcription factors, and/or cytokines, second messengers, and cellular accessory molecules including, but not limited to, La antigen (see for example Costa-Mattioli et al., 2004, Mol Cell Biol., 24, 6861-70, e.g., Genbank Accession No. NM_003142); FAS (e.g., Genbank Accession No. NM_000043) or FAS ligand (e.g., Genbank Accession No. NM_000639); interferon regulatory factors (IRFs; e.g., Genbank Accession No. AF082503.1); cellular PKR protein kinase (e.g., Genbank Accession No. XM_002661.7); human eukaryotic initiation factors 2B (elF2Bgamma; e.g., Genbank Accession No. AF256223, and/or elF2gamma; e.g., Genbank Accession No. NM_006874.1); human DEAD Box protein (DDX3; e.g., Genbank Accession No. XM_018021.2); and cellular proteins that bind to the poly(U) tract of the HCV 3'-UTR, such as polypyrimidine tract-binding protein (e.g., Genbank Accession Nos. NM_031991.1 and XM_042972.3). Such cellular targets are also referred to herein generally as HCV targets, and specifically as "host target" or "host targets".

Due to the potential for high sequence variability of the HCV genome, selection of siNA molecules for broad therapeutic applications likely involve the conserved regions of the HCV genome. In one embodiment, the present invention relates to siNA molecules and/or RNAi inhibitors that target the conserved regions of the HCV genome or regions that are conserved across different targets. Examples of conserved regions of the HCV genome include, but are not limited to, the 5'-Non Coding Region (NCR, also referred to as the 5'-untranslated region, UTR), the 5'-end of the core protein coding region, and the 3'-NCR. HCV genomic RNA contains an internal ribosome entry site (IRES) in the 5'-NCR which mediates translation independently of a 5'-cap structure (Wang et al., 1993, *J. Virol.*, 67, 3338-44). The full-length sequence of the HCV RNA genome is heterologous among clinically isolated subtypes, of which there are at least fifteen (Simmonds, 1995, Hepatology, 21, 570-583), however, the 5'-NCR sequence of HCV is highly conserved across all known subtypes, most likely to preserve the shared IRES mechanism (Okamoto et al., 1991, *J. General Virol.*, 72, 2697-2704). Therefore, a siNA molecule can be designed to target the different isolates of HCV by targeting a conserved region, such as the 5' NCR sequence. siNA molecules and/or RNAi inhibitors designed to target conserved regions of various HCV isolates enable efficient inhibition of HCV replication in diverse patient populations and ensure the effectiveness of the siNA molecules against HCV quasi species which evolve due to mutations in the non-conserved regions of the HCV genome. As described, a single siNA molecule can be targeted against all isolates of HCV by designing the siNA molecule to interact with conserved nucleotide sequences of HCV (e.g., sequences that are expected to be present in the RNA of various HCV isolates).

In one embodiment, the invention features a double stranded nucleic acid molecule, such as an siNA molecule, where one of the strands comprises nucleotide sequence having complementarity to a predetermined nucleotide sequence in a target nucleic acid molecule, or a portion thereof. In one embodiment, the predetermined nucleotide sequence is a nucleotide target sequence described herein. In another embodiment, the predetermined nucleotide sequence is a target sequence as is known in the art.

In one embodiment, the invention features a double-stranded short interfering nucleic acid (siNA) molecule that down-regulates expression of a target gene or that directs cleavage of a target RNA, wherein said siNA molecule comprises about 15 to about 28 base pairs.

In one embodiment, the invention features a double-stranded short interfering nucleic acid (siNA) molecule that directs cleavage of a target RNA, wherein said siNA molecule comprises about 15 to about 28 base pairs.

In one embodiment, the invention features a double stranded short interfering nucleic acid (siNA) molecule that directs cleavage of a target RNA via RNA interference (RNAi), wherein the double stranded siNA molecule comprises a first strand and a second strand, each strand of the siNA molecule is about 18 to about 28 (e.g., about 18, 19, 20, 21, 22, 23, 24, 25, 26, 27, or 28) nucleotides in length, the first strand of the siNA molecule comprises nucleotide sequence having sufficient complementarity to the target RNA for the siNA molecule to direct cleavage of the target RNA via RNA interference, and the second strand of said siNA molecule comprises nucleotide sequence that is complementary to the first strand. In one specific embodiment, for example, each strand of the siNA molecule is about 18 to about 27 nucleotides in length.

In one embodiment, the invention features a double stranded short interfering nucleic acid (siNA) molecule that directs cleavage of a target RNA via RNA interference (RNAi), wherein the double stranded siNA molecule comprises a first strand and a second strand, each strand of the siNA molecule is about 18 to about 23 (e.g., about 18, 19, 20, 21, 22, or 23) nucleotides in length, the first strand of the siNA molecule comprises nucleotide sequence having sufficient complementarity to the target RNA for the siNA molecule to direct cleavage of the target RNA via RNA interference, and the second strand of said siNA molecule comprises nucleotide sequence that is complementary to the first strand.

In one embodiment, the invention features a chemically synthesized double stranded short interfering nucleic acid (siNA) molecule that directs cleavage of a target RNA via RNA interference (RNAi), wherein each strand of the siNA molecule is about 18 to about 28 nucleotides in length; and one strand of the siNA molecule comprises nucleotide sequence having sufficient complementarity to the target RNA for the siNA molecule to direct cleavage of the target RNA via RNA interference.

In one embodiment, the invention features a chemically synthesized double stranded short interfering nucleic acid (siNA) molecule that directs cleavage of a target RNA via RNA interference (RNAi), wherein each strand of the siNA molecule is about 18 to about 23 nucleotides in length; and one strand of the siNA molecule comprises nucleotide sequence having sufficient complementarity to the target RNA for the siNA molecule to direct cleavage of the target RNA via RNA interference.

In one embodiment, the invention features a siNA molecule that down-regulates expression of a target gene or that directs cleavage of a target RNA, for example, wherein the target gene or RNA comprises protein encoding sequence. In one embodiment, the invention features a siNA molecule that down-regulates expression of a target gene or that directs cleavage of a target RNA, for example, wherein the target gene or RNA comprises non-coding sequence or regulatory elements involved in target gene expression (e.g., non-coding RNA, miRNA, stRNA etc.).

In one embodiment, a siNA of the invention is used to inhibit the expression of target genes or a target gene family (e.g., different HCV strains), wherein the genes or gene family sequences share sequence homology. Such homologous sequences can be identified as is known in the art, for example using sequence alignments. siNA molecules can be designed to target such homologous sequences, for example using perfectly complementary sequences or by incorporating non-canonical base pairs, for example mismatches and/or wobble base pairs, that can provide additional target sequences. In instances where mismatches are identified, non-canonical base pairs (for example, mismatches and/or wobble bases) can be used to generate siNA molecules that target more than one gene sequence. In a non-limiting example, non-canonical base pairs such as UU and CC base pairs are used to generate siNA molecules that are capable of targeting sequences for differing polynucleotide targets that share sequence homology. As such, one advantage of using siNAs of the invention is that a single siNA can be designed to include nucleic acid sequence that is complementary to the nucleotide sequence that is conserved between the homologous genes. In this approach, a single siNA can be used to inhibit expression of more than one gene instead of using more than one siNA molecule to target the different genes.

In one embodiment, the invention features a siNA molecule having RNAi activity against target RNA (e.g., coding or non-coding RNA), wherein the siNA molecule comprises a sequence complementary to any RNA sequence, such as those sequences having GenBank Accession Nos. shown in shown in Table I, PCT/US03/05028, U.S. Provisional Patent Application No. 60/363,124, or U.S. Ser. No. 10/923,536 and U.S. Ser. No. 10/444,853, all of which are incorporated by reference herein. In another embodiment, the invention features a siNA molecule having RNAi activity against target RNA, wherein the siNA molecule comprises a sequence complementary to an RNA having variant encoding sequence, for example other mutant genes known in the art to be associated with the maintenance and/or development of diseases, traits, disorders, and/or conditions described herein or otherwise known in the art. Chemical modifications as shown in Tables III and IV or otherwise described herein can be applied to any siNA construct of the invention. In another embodiment, a siNA molecule of the invention includes a nucleotide sequence that can interact with nucleotide sequence of a HCV target gene and thereby mediate silencing of HCV target gene expression, for example, wherein the siNA mediates regulation of HCV target gene expression by cellular processes that modulate the chromatin structure or methylation patterns of the HCV target gene and prevent transcription of the HCV target gene.

In one embodiment, siNA molecules of the invention are used to down regulate or inhibit the expression of proteins arising from haplotype polymorphisms that are associated with a trait, disease or condition in a subject or organism. Analysis of genes, or protein or RNA levels can be used to identify subjects with such polymorphisms or those subjects who are at risk of developing traits, conditions, or diseases described herein. These subjects are amenable to treatment, for example, treatment with siNA molecules of the invention and any other composition useful in treating diseases related to target gene expression. As such, analysis of protein or RNA levels can be used to determine treatment type and the course of therapy in treating a subject. Monitoring of protein or RNA levels can be used to predict treatment outcome and to determine the efficacy of compounds and compositions that modulate the level and/or activity of certain proteins associated with a trait, disorder, condition, or disease.

In one embodiment of the invention a siNA molecule comprises an antisense strand comprising a nucleotide sequence that is complementary to a nucleotide sequence or a portion thereof encoding a HCV target protein. The siNA further comprises a sense strand, wherein said sense strand comprises a nucleotide sequence of a HCV target gene or a portion thereof.

In another embodiment, a siNA molecule comprises an antisense region comprising a nucleotide sequence that is complementary to a nucleotide sequence encoding a HCV target protein or a portion thereof. The siNA molecule further comprises a sense region, wherein said sense region comprises a nucleotide sequence of a HCV target gene or a portion thereof.

In another embodiment, the invention features a siNA molecule comprising nucleotide sequence, for example, nucleotide sequence in the antisense region of the siNA molecule that is complementary to a nucleotide sequence or portion of sequence of a HCV target gene. In another embodiment, the invention features a siNA molecule comprising a region, for example, the antisense region of the siNA construct, complementary to a sequence comprising a HCV target gene sequence or a portion thereof.

In one embodiment, the sense region or sense strand of a siNA molecule of the invention is complementary to that portion of the antisense region or antisense strand of the siNA molecule that is complementary to a HCV target polynucleotide sequence.

In yet another embodiment, the invention features a siNA molecule comprising a sequence, for example, the antisense sequence of the siNA construct, complementary to a sequence or portion of sequence comprising sequence represented by GenBank Accession Nos. shown in PCT/US03/05028, U.S. Provisional Patent Application No. 60/363,124, and/or in U.S. Ser. No. 10/923,536 and U.S. Ser. No. 10/444,853, all of which are incorporated by reference herein. Chemical modifications in Tables III and IV and otherwise described herein can be applied to any siNA construct of the invention. LNP formulations described in Table VI can be applied to any siNA molecule or combination of siNA molecules herein.

In one embodiment of the invention a siNA molecule comprises an antisense strand having about 15 to about 30 (e.g., about 15, 16, 17, 18, 19, 20, 21, 22, 23, 24, 25, 26, 27, 28, 29, or 30) nucleotides, wherein the antisense strand is complementary to a HCV target RNA sequence or a portion thereof, and wherein said siNA further comprises a sense strand having about 15 to about 30 (e.g., about 15, 16, 17, 18, 19, 20, 21, 22, 23, 24, 25, 26, 27, 28, 29, or 30) nucleotides, and wherein said sense strand and said antisense strand are distinct nucleotide sequences where at least about 15 nucleotides in each strand are complementary to the other strand.

In one embodiment, a siNA molecule of the invention (e.g., a double stranded nucleic acid molecule) comprises an antisense (guide) strand having about 15 to about 30 (e.g., about 15, 16, 17, 18, 19, 20, 21, 22, 23, 24, 25, 26, 27, 28, 29, or 30) nucleotides that are complementary to a target RNA sequence or a portion thereof. In one embodiment, at least 15 nucleotides (e.g., 15, 16, 17, 18, 19, 20, 21, 22, 23, 24, 25, 26, 27, 28, 29, or 30 nucleotides) of a target RNA sequence are complementary to the antisense (guide) strand of a siNA molecule of the invention.

In one embodiment, a siNA molecule of the invention (e.g., a double stranded nucleic acid molecule) comprises a sense (passenger) strand having about 15 to about 30 (e.g., about 15, 16, 17, 18, 19, 20, 21, 22, 23, 24, 25, 26, 27, 28, 29, or 30) nucleotides that comprise sequence of a target RNA or a portion thereof. In one embodiment, at least 15 nucleotides (e.g., about 15, 16, 17, 18, 19, 20, 21, 22, 23, 24, 25, 26, 27, 28, 29, or 30) nucleotides of a target RNA sequence comprise the sense (passenger) strand of a siNA molecule of the invention.

In another embodiment of the invention a siNA molecule of the invention comprises an antisense region having about 15 to about 30 (e.g., about 15, 16, 17, 18, 19, 20, 21, 22, 23, 24, 25, 26, 27, 28, 29, or 30) nucleotides, wherein the antisense region is complementary to a target DNA sequence, and wherein said siNA further comprises a sense region having about 15 to about 30 (e.g., about 15, 16, 17, 18, 19, 20, 21, 22, 23, 24, 25, 26, 27, 28, 29, or 30) nucleotides, wherein said sense region and said antisense region are comprised in a linear molecule where the sense region comprises at least about 15 nucleotides that are complementary to the antisense region.

In one embodiment, a siNA molecule of the invention has RNAi activity that modulates expression of RNA encoded by a HCV gene. Because HCV genes can share some degree of sequence homology with each other, siNA molecules can be designed to target a class of HCV genes (e.g., a class of different HCV strains) or alternately specific HCV genes (e.g., escape mutants, resistant strains, or other polymorphic variants) by selecting sequences that are either shared amongst different HCV targets or alternatively that are unique for a specific HCV target. Therefore, in one embodiment, the siNA molecule can be designed to target conserved regions of HCV RNA sequences having homology among several HCV gene variants so as to target a class of HCV genes with one siNA molecule. Accordingly, in one embodiment, the siNA molecule of the invention modulates the expression of one or more HCV stains in a subject or organism. In another embodiment, the siNA molecule can be designed to target a sequence that is unique to a specific HCV RNA sequence (e.g., a single HCV strain or HCV single nucleotide polymorphism (SNP)) due to the high degree of specificity that the siNA molecule requires to mediate RNAi activity.

In one embodiment, nucleic acid molecules of the invention that act as mediators of the RNA interference gene silencing response are double-stranded nucleic acid molecules. In another embodiment, the siNA molecules of the invention consist of duplex nucleic acid molecules containing about 15 to about 30 base pairs between oligonucleotides comprising about 15 to about 30 (e.g., about 15, 16, 17, 18, 19, 20, 21, 22, 23, 24, 25, 26, 27, 28, 29, or 30) nucleotides. In yet another embodiment, siNA molecules of the invention comprise duplex nucleic acid molecules with overhanging ends of about 1 to about 3 (e.g., about 1, 2, or 3) nucleotides, for example, about 21-nucleotide duplexes with about 19 base pairs and 3'-terminal mononucleotide, dinucleotide, or trinucleotide overhangs. In yet another embodiment, siNA molecules of the invention comprise duplex nucleic acid molecules with blunt ends, where both ends are blunt, or alternatively, where one of the ends is blunt.

In one embodiment, a double stranded nucleic acid (e.g., siNA) molecule comprises nucleotide or non-nucleotide overhangs. By "overhang" is meant a terminal portion of the nucleotide sequence that is not base paired between the two strands of a double stranded nucleic acid molecule (see for example FIG. 6). In one embodiment, a double stranded nucleic acid molecule of the invention can comprise nucleotide or non-nucleotide overhangs at the 3'-end of one or both strands of the double stranded nucleic acid molecule. For example, a double stranded nucleic acid molecule of the invention can comprise a nucleotide or non-nucleotide overhang at the 3'-end of the guide strand or antisense strand/region, the 3'-end of the passenger strand or sense strand/region, or both the guide strand or antisense strand/region and the passenger strand or sense strand/region of the double stranded nucleic acid molecule. In another embodiment, the nucleotide overhang portion of a double stranded nucleic acid (siNA) molecule of the invention comprises 2'-O-methyl, 2'-deoxy, 2'-deoxy-2'-fluoro, 2'-deoxy-2'-fluoroarabino (FANA), 4'-thio, 2'-O-trifluoromethyl, 2'-O-ethyl-trifluoromethoxy, 2'-O-difluoromethoxy-ethoxy, universal base, acyclic, or 5-C-methyl nucleotides. In another embodiment, the non-nucleotide overhang portion of a double stranded nucleic acid (siNA) molecule of the invention comprises glyceryl, abasic, or inverted deoxy abasic non-nucleotides.

In one embodiment, the nucleotides comprising the overhang portions of a double stranded nucleic acid (e.g., siNA) molecule of the invention correspond to the nucleotides comprising the HCV target polynucleotide sequence of the siNA molecule. Accordingly, in such embodiments, the nucleotides comprising the overhang portion of a siNA molecule of the invention comprise sequence based on the HCV target polynucleotide sequence in which nucleotides comprising the overhang portion of the guide strand or antisense strand/region of a siNA molecule of the invention can be complementary to nucleotides in the HCV target polynucleotide sequence and nucleotides comprising the overhang portion of the passenger strand or sense strand/region of a siNA molecule of the invention can comprise the nucleotides in the HCV target polynucleotide sequence. Such nucleotide overhangs comprise sequence that would result from Dicer processing of a native dsRNA into siRNA.

In one embodiment, the nucleotides comprising the overhang portion of a double stranded nucleic acid (e.g., siNA) molecule of the invention are complementary to the HCV target polynucleotide sequence and are optionally chemically modified as described herein. As such, in one embodiment, the nucleotides comprising the overhang portion of the guide strand or antisense strand/region of a siNA molecule of the invention can be complementary to nucleotides in the HCV target polynucleotide sequence, i.e. those nucleotide positions in the HCV target polynucleotide sequence that are complementary to the nucleotide positions of the overhang nucleotides in the guide strand or antisense strand/region of a siNA molecule. In another embodiment, the nucleotides comprising the overhang portion of the passenger strand or sense strand/region of a siNA molecule of the invention can comprise the nucleotides in the HCV target polynucleotide sequence, i.e. those nucleotide positions in the HCV target polynucleotide sequence that correspond to same the nucleotide positions of the overhang nucleotides in the passenger strand or sense strand/region of a siNA molecule. In one embodiment, the overhang comprises a two nucleotide (e.g., 3'-GA; 3'-GU; 3'-GG; 3'GC; 3'-CA; 3'-CU; 3'-CG; 3'CC; 3'-UA; 3'-UU; 3'-UG; 3'UC; 3'-AA; 3'-AU; 3'-AG; 3'-AC; 3'-TA; 3'-TU; 3'-TG; 3'-TC; 3'-AT; 3'-UT; 3'-GT; 3'-CT) overhang that is complementary to a portion of the HCV target polynucleotide sequence. In one embodiment, the overhang comprises a two nucleotide (e.g., 3'-GA; 3'-GU; 3'-GG; 3'GC; 3'-CA; 3'-CU; 3'-CG; 3'CC; 3'-UA; 3'-UU; 3'-UG; 3'UC; 3'-AA; 3'-AU; 3'-AG; 3'-AC; 3'-TA; 3'-TU; 3'-TG; 3'-TC; 3'-AT; 3'-UT; 3'-GT; 3'-CT) overhang that is not complementary to a portion of the HCV target polynucleotide sequence. In another embodiment, the overhang nucleotides of a siNA molecule of the invention are 2'-O-methyl nucleotides, 2'-deoxy-2'-fluoroarabino, and/or 2'-deoxy-2'-fluoro nucleotides. In another embodiment, the overhang nucleotides of a siNA molecule of the invention are 2'-O-methyl nucleotides in the event the overhang nucleotides are purine nucleotides and/or 2'-deoxy-2'-fluoro nucleotides or 2'-deoxy-2'-fluoroarabino nucleotides in the event the overhang nucleotides are pyrimidines nucleotides. In another embodiment, the purine nucleotide (when present) in an overhang of siNA molecule of the invention is 2'-O-methyl nucleotides. In another embodiment, the pyrimidine nucleotides (when present) in an overhang of siNA molecule of the invention are 2'-deoxy-2'-fluoro or 2'-deoxy-2'-fluoroarabino nucleotides.

In one embodiment, the nucleotides comprising the overhang portion of a double stranded nucleic acid (e.g., siNA) molecule of the invention are not complementary to the HCV target polynucleotide sequence and are optionally chemically modified as described herein. In one embodiment, the overhang comprises a 3'-UU overhang that is not complementary to a portion of the HCV target polynucleotide sequence. In another embodiment, the nucleotides comprising the overhanging portion of a siNA molecule of the invention are 2'-O-methyl nucleotides, 2'-deoxy-2'-fluoroarabino and/or 2'-deoxy-2'-fluoro nucleotides.

In one embodiment, the double stranded nucleic molecule (e.g. siNA) of the invention comprises a two or three nucleotide overhang, wherein the nucleotides in the overhang are the same or different. In one embodiment, the double stranded nucleic molecule (e.g. siNA) of the invention comprises a two or three nucleotide overhang, wherein the nucleotides in the overhang are the same or different and wherein one or more nucleotides in the overhang are chemically modified at the base, sugar and/or phosphate backbone.

In one embodiment, the invention features one or more chemically-modified siNA constructs having specificity for HCV target nucleic acid molecules, such as DNA, or RNA encoding a protein or non-coding RNA associated with the expression of HCV target genes.

In one embodiment, the invention features a RNA based siNA molecule (e.g., a siNA comprising 2'-OH nucleotides) having specificity for nucleic acid molecules that includes one or more chemical modifications described herein. Non-limiting examples of such chemical modifications include without limitation phosphorothioate internucleotide linkages, 2'-deoxyribonucleotides, 2'-O-methyl ribonucleotides, 2'-deoxy-2'-fluoro ribonucleotides, 4'-thio ribonucleotides, 2'-O-trifluoromethyl nucleotides, 2'-O-ethyl-trifluoromethoxy nucleotides, 2'-O-difluoromethoxy-ethoxy nucleotides (see for example U.S. Ser. No. 10/981,966 filed Nov. 5, 2004, incorporated by reference herein), "universal base" nucleotides, "acyclic" nucleotides, 5-C-methyl nucleotides, 2'-deoxy-2'-fluoroarabino (FANA, see for example Dowler et al., 2006, Nucleic Acids Research, 34, 1669-1675) and terminal glyceryl and/or inverted deoxy abasic residue incorporation. These chemical modifications, when used in various siNA constructs, (e.g., RNA based siNA constructs), are shown to preserve RNAi activity in cells while at the same time, dramatically increasing the serum stability of these compounds.

In one embodiment, a siNA molecule of the invention comprises chemical modifications described herein (e.g., 2'-O-methyl ribonucleotides, 2'-deoxy-2'-fluoro ribonucleotides, 4'-thio ribonucleotides, 2'-O-trifluoromethyl nucleotides, 2'-O-ethyl-trifluoromethoxy nucleotides, 2'-O-difluoromethoxy-ethoxy nucleotides, LNA) at the internal positions of the siNA molecule. By "internal position" is meant the base paired positions of a siNA duplex.

In one embodiment, a siNA molecule of the invention comprises modified nucleotides while maintaining the ability to mediate RNAi. The modified nucleotides can be used to improve in vitro or in vivo characteristics such as stability, activity, toxicity, immune response, and/or bioavailability. For example, a siNA molecule of the invention can comprise modified nucleotides as a percentage of the total number of nucleotides present in the siNA molecule. As such, a siNA molecule of the invention can generally comprise about 5% to about 100% modified nucleotides (e.g., about 5%, 10%, 15%, 20%, 25%, 30%, 35%, 40%, 45%, 50%, 55%, 60%, 65%, 70%, 75%, 80%, 85%, 90%, 95% or 100% modified nucleotides). For example, in one embodiment, between about 5% to about 100% (e.g., about 5%, 10%, 15%, 20%, 25%, 30%, 35%, 40%, 45%, 50%, 55%, 60%, 65%, 70%, 75%, 80%, 85%, 90%, 95% or 100% modified nucleotides) of the nucleotide positions in a siNA molecule of the invention comprise a nucleic acid sugar modification, such as a 2'-sugar modification, e.g., 2'-O-methyl nucleotides, 2'-deoxy-2'-fluoro nucleotides, 2'-deoxy-2'-fluoroarabino, 2'-O-methoxyethyl nucleotides, 2'-O-trifluoromethyl nucleotides, 2'-O-ethyl-trifluoromethoxy nucleotides, 2'-O-difluoromethoxy-ethoxy nucleotides, or 2'-deoxy nucleotides. In another embodiment, between about 5% to about 100% (e.g., about 5%, 10%, 15%, 20%, 25%, 30%, 35%, 40%, 45%, 50%, 55%, 60%, 65%, 70%, 75%, 80%, 85%, 90%, 95% or 100% modified nucleotides) of the nucleotide positions in a siNA molecule of the invention comprise a nucleic acid base modification, such as inosine, purine, pyridin-4-one, pyridin-2-one, phenyl, pseudouracil, 2,4,6-trimethoxy benzene, 3-methyl uracil, dihydrouridine, naphthyl, aminophenyl, 5-alkylcytidines (e.g., 5-methylcytidine), 5-alkyluridines (e.g., ribothymidine), 5-halouridine (e.g., 5-bromouridine) or 6-azapyrimidines or 6-alkylpyrimidines (e.g. 6-methyluridine), or propyne modifications. In another embodiment, between about 5% to about 100% (e.g., about 5%, 10%, 15%, 20%, 25%, 30%, 35%, 40%, 45%, 50%, 55%, 60%, 65%, 70%, 75%, 80%, 85%, 90%, 95% or 100% modified nucleotides) of the nucleotide positions in a siNA molecule of the invention comprise a nucleic acid backbone modification, such as a backbone modification having Formula I herein. In another embodiment, between about 5% to about 100% (e.g., about 5%, 10%, 15%, 20%, 25%, 30%, 35%, 40%, 45%, 50%, 55%, 60%, 65%, 70%, 75%, 80%, 85%, 90%, 95% or 100% modified nucleotides) of the nucleotide positions in a siNA molecule of the invention comprise a nucleic acid sugar, base, or backbone modification or any combination thereof (e.g., any combination of nucleic acid sugar, base, backbone or non-nucleotide modifications herein). In one embodiment, a siNA molecule of the invention comprises at least about 20%, 25%, 30%, 35%, 40%, 45%, 50%, 55%, 60%, 65%, 70%, 75%, 80%, 85%, 90%, 95% or 100% modified nucleotides. The actual percentage of modified nucleotides present in a given siNA molecule will depend on the total number of nucleotides present in the siNA. If the siNA molecule is single stranded, the percent modification can be based upon the total number of nucleotides present in the single stranded siNA molecules. Likewise, if the siNA molecule is double stranded, the percent modification can be based upon the total number of nucleotides present in the sense strand, antisense strand, or both the sense and antisense strands.

A siNA molecule of the invention can comprise modified nucleotides at various locations within the siNA molecule. In one embodiment, a double stranded siNA molecule of the invention comprises modified nucleotides at internal base paired positions within the siNA duplex. For example, internal positions can comprise positions from about 3 to about 19 nucleotides from the 5'-end of either sense or antisense strand or region of a 21 nucleotide siNA duplex having 19 base pairs and two nucleotide 3'-overhangs. In another embodiment, a double stranded siNA molecule of the invention comprises modified nucleotides at non-base paired or overhang regions of the siNA molecule. By "non-base paired" is meant, the nucleotides are not base paired between the sense strand or sense region and the antisense strand or antisense region or the siNA molecule. The overhang nucleotides can be complementary or base paired to a corresponding HCV target polynucleotide sequence (see for example FIG. 6C). For example, overhang positions can comprise positions from about 20 to about 21 nucleotides from the 5'-end of either sense or antisense strand or region of a 21 nucleotide siNA duplex having 19 base pairs and two nucleotide 3'-overhangs. In another embodiment, a double stranded siNA molecule of the invention comprises modified nucleotides at terminal positions of the siNA molecule. For example, such terminal regions include the 3'-position, 5'-position, for both 3' and 5'-positions of the sense and/or antisense strand or region of the siNA molecule. In another embodiment, a double stranded siNA molecule of the invention comprises modified nucleotides at base-paired or internal positions, non-base paired or overhang regions, and/or terminal regions, or any combination thereof.

One aspect of the invention features a double-stranded short interfering nucleic acid (siNA) molecule that down-regulates expression of a HCV target gene or that directs cleavage of a HCV target RNA. In one embodiment, the double stranded siNA molecule comprises one or more chemical modifications and each strand of the double-stranded siNA is about 21 nucleotides long. In one embodiment, the double-stranded siNA molecule does not contain any ribonucleotides. In another embodiment, the double-stranded siNA molecule comprises one or more ribonucleotides. In one embodiment, each strand of the double-stranded siNA molecule independently comprises about 15 to about 30 (e.g., about 15, 16, 17, 18, 19, 20, 21, 22, 23, 24, 25, 26, 27, 28, 29, or 30) nucleotides, wherein each strand comprises about 15 to about 30 (e.g., about 15, 16, 17, 18, 19, 20, 21, 22, 23, 24, 25, 26, 27, 28, 29, or 30) nucleotides that are complementary to the nucleotides of the other strand. In one embodiment, one of the strands of the double-stranded siNA molecule comprises a nucleotide sequence that is complementary to a nucleotide sequence or a portion thereof of the HCV target gene, and the second strand of the double-stranded siNA molecule comprises a nucleotide sequence substantially similar to the nucleotide sequence of the HCV target gene or a portion thereof.

In another embodiment, the invention features a double-stranded short interfering nucleic acid (siNA) molecule that down-regulates expression of a HCV target gene or that directs cleavage of a HCV target RNA, comprising an antisense region, wherein the antisense region comprises a nucleotide sequence that is complementary to a nucleotide sequence of the HCV target gene or a portion thereof, and a sense region, wherein the sense region comprises a nucleotide sequence substantially similar to the nucleotide sequence of the target gene or a portion thereof. In one embodiment, the antisense region and the sense region independently comprise about 15 to about 30 (e.g. about 15, 16, 17, 18, 19, 20, 21, 22, 23, 24, 25, 26, 27, 28, 29, or 30) nucleotides, wherein the antisense region comprises about 15 to about 30 (e.g. about 15, 16, 17, 18, 19, 20, 21, 22, 23, 24, 25, 26, 27, 28, 29, or 30) nucleotides that are complementary to nucleotides of the sense region.

In another embodiment, the invention features a double-stranded short interfering nucleic acid (siNA) molecule that down-regulates expression of a HCV target gene or that directs cleavage of a HCV target RNA, comprising a sense region and an antisense region, wherein the antisense region comprises a nucleotide sequence that is complementary to a nucleotide sequence of RNA encoded by the HCV target gene or a portion thereof and the sense region comprises a nucleotide sequence that is complementary to the antisense region.

In one embodiment, a siNA molecule of the invention comprises blunt ends, i.e., ends that do not include any overhanging nucleotides. For example, a siNA molecule comprising modifications described herein (e.g., comprising nucleotides having Formulae I-VII or siNA constructs comprising "Stab 00"-"Stab 36" or "Stab 3F"-"Stab 36F" (Table IV) or any combination thereof) and/or any length described herein can comprise blunt ends or ends with no overhanging nucleotides.

In one embodiment, any siNA molecule of the invention can comprise one or more blunt ends, i.e. where a blunt end does not have any overhanging nucleotides. In one embodiment, the blunt ended siNA molecule has a number of base pairs equal to the number of nucleotides present in each strand of the siNA molecule. In another embodiment, the siNA molecule comprises one blunt end, for example wherein the 5'-end of the antisense strand and the 3'-end of the sense strand do not have any overhanging nucleotides. In another example, the siNA molecule comprises one blunt end, for example wherein the 3'-end of the antisense strand and the 5'-end of the sense strand do not have any overhanging nucleotides. In another example, a siNA molecule comprises two blunt ends, for example wherein the 3'-end of the antisense strand and the 5'-end of the sense strand as well as the 5'-end of the antisense strand and 3'-end of the sense strand do not have any overhanging nucleotides. A blunt ended siNA molecule can comprise, for example, from about 15 to about 30 nucleotides (e.g., about 15, 16, 17, 18, 19, 20, 21, 22, 23, 24, 25, 26, 27, 28, 29, or 30 nucleotides). Other nucleotides present in a blunt ended siNA molecule can comprise, for example, mismatches, bulges, loops, or wobble base pairs to modulate the activity of the siNA molecule to mediate RNA interference.

By "blunt ends" is meant symmetric termini or termini of a double stranded siNA molecule having no overhanging nucleotides. The two strands of a double stranded siNA molecule align with each other without over-hanging nucleotides at the termini. For example, a blunt ended siNA construct comprises terminal nucleotides that are complementary between the sense and antisense regions of the siNA molecule.

In one embodiment, the invention features a double-stranded short interfering nucleic acid (siNA) molecule that down-regulates expression of a HCV target gene or that directs cleavage of a HCV target RNA, wherein the siNA molecule is assembled from two separate oligonucleotide fragments wherein one fragment comprises the sense region and the second fragment comprises the antisense region of the siNA molecule. The sense region can be connected to the antisense region via a linker molecule, such as a polynucleotide linker or a non-nucleotide linker.

In one embodiment, a double stranded nucleic acid molecule (e.g., siNA) molecule of the invention comprises ribonucleotides at positions that maintain or enhance RNAi activity. In one embodiment, ribonucleotides are present in the sense strand or sense region of the siNA molecule, which can provide for RNAi activity by allowing cleavage of the sense strand or sense region by an enzyme within the RISC (e.g., ribonucleotides present at the position of passenger strand, sense strand, or sense region cleavage, such as position 9 of the passenger strand of a 19 base-pair duplex, which is cleaved in the RISC by AGO2 enzyme, see for example Matranga et al., 2005, *Cell,* 123:1-114 and Rand et al., 2005, *Cell,* 123:621-629). In another embodiment, one or more (for example 1, 2, 3, 4 or 5) nucleotides at the 5'-end of the guide strand or guide region (also known as antisense strand or antisense region) of the siNA molecule are ribonucleotides.

In one embodiment, a double stranded nucleic acid molecule (e.g., siNA) molecule of the invention comprises one or more ribonucleotides at positions within the passenger strand or passenger region (also known as the sense strand or sense region) that allows cleavage of the passenger strand or passenger region by an enzyme in the RISC.

In one embodiment, a siNA molecule of the invention contains at least 2, 3, 4, 5, or more chemical modifications that can be the same of different. In another embodiment, a siNA molecule of the invention contains at least 2, 3, 4, 5, or more different chemical modifications.

In one embodiment, a siNA molecule of the invention is double-stranded and comprises about 15 to about 30 (e.g. about 15, 16, 17, 18, 19, 20, 21, 22, 23, 24, 25, 26, 27, 28, 29, or 30) base pairs, and wherein one or more (e.g., at least 1, 2, 3, 4, 5, 6, 7, 8, 9, 10, 11, 12, 13, 14, 15, 16, 17, 18, 19, 20, 21, 22, 23, 24, 25, 26, 27, 28, 29, or 30) of the nucleotide positions in each strand of the siNA molecule comprises a chemical modification. In another embodiment, the siNA contains at least 2, 3, 4, 5, or more different chemical modifications.

In one embodiment, the invention features double-stranded short interfering nucleic acid (siNA) molecule that down-regulates expression of a HCV target gene or that directs cleavage of a HCV target RNA, wherein the siNA molecule comprises about 15 to about 30 (e.g. about 15, 16, 17, 18, 19, 20, 21, 22, 23, 24, 25, 26, 27, 28, 29, or 30) base pairs, and wherein each strand of the siNA molecule comprises one or more chemical modifications. In one embodiment, each strand of the double stranded siNA molecule comprises at least two (e.g., 2, 3, 4, 5, or more) different chemical modifications, e.g., different nucleotide sugar, base, or backbone modifications. In another embodiment, one of the strands of the double-stranded siNA molecule comprises a nucleotide sequence that is complementary to a nucleotide sequence of a HCV target gene or a portion thereof, and the second strand of the double-stranded siNA molecule comprises a nucleotide sequence substantially similar to the nucleotide sequence or a portion thereof of the HCV target gene. In another embodiment, one of the strands of the double-stranded siNA molecule comprises a nucleotide sequence that is complementary to a nucleotide sequence of a HCV target gene or portion thereof, and the second strand of the double-stranded siNA molecule comprises a nucleotide sequence substantially similar to the nucleotide sequence or portion thereof of the HCV target gene. In another embodiment, each strand of the siNA molecule comprises about 15 to about 30 (e.g. about 15, 16, 17, 18, 19, 20, 21, 22, 23, 24, 25, 26, 27, 28, 29, or 30) nucleotides, and each strand comprises at least about 15 to about 30 (e.g. about 15, 16, 17, 18, 19, 20, 21, 22, 23, 24, 25, 26, 27, 28, 29, or 30) nucleotides that are complementary to the nucleotides of the other strand. The HCV target gene can comprise, for example, sequences referred to herein or incorporated herein by reference. The HCV gene can comprise, for example, sequences referred to by GenBank Accession number herein.

In one embodiment, each strand of a double stranded siNA molecule of the invention comprises a different pattern of chemical modifications, such as any "Stab 00"-"Stab 36" or "Stab 3F"-"Stab 36F" (Table IV) modification patterns herein or any combination thereof. Non-limiting examples of sense and antisense strands of such siNA molecules having various modification patterns are shown in Table III and FIGS. 4 and 5.

In one embodiment, a siNA molecule of the invention comprises no ribonucleotides. In another embodiment, a siNA molecule of the invention comprises one or more ribonucleotides (e.g., 1, 2, 3, 4, 5, 6, 7, 8, 9, 10, or more ribonucleotides).

In one embodiment, a siNA molecule of the invention comprises an antisense region comprising a nucleotide sequence that is complementary to a nucleotide sequence of a HCV target gene or a portion thereof, and the siNA further comprises a sense region comprising a nucleotide sequence substantially similar to the nucleotide sequence of the HCV target gene or a portion thereof. In another embodiment, the antisense region and the sense region each comprise about 15 to about 30 (e.g. about 15, 16, 17, 18, 19, 20, 21, 22, 23, 24, 25, 26, 27, 28, 29, or 30) nucleotides and the antisense region comprises at least about 15 to about 30 (e.g. about 15, 16, 17, 18, 19, 20, 21, 22, 23, 24, 25, 26, 27, 28, 29, or 30) nucleotides that are complementary to nucleotides of the sense region. In one embodiment, each strand of the double stranded siNA molecule comprises at least two (e.g., 2, 3, 4, 5, or more) different chemical modifications, e.g., different nucleotide sugar, base, or backbone modifications. The HCV target gene can comprise, for example, sequences referred to herein or incorporated by reference herein. In another embodiment, the siNA is a double stranded nucleic acid molecule, where each of the two strands of the siNA molecule independently comprise about 15 to about 40 (e.g. about 15, 16, 17, 18, 19, 20, 21, 22, 23, 24, 25, 26, 27, 28, 29, 30, 31, 23, 33, 34, 35, 36, 37, 38, 39, or 40) nucleotides, and where one of the strands of the siNA molecule comprises at least about 15 (e.g. about 15, 16, 17, 18, 19, 20, 21, 22, 23, 24 or 25 or more) nucleotides that are complementary to the nucleic acid sequence of the HCV target gene or a portion thereof.

In one embodiment, a siNA molecule of the invention comprises a sense region and an antisense region, wherein the antisense region comprises a nucleotide sequence that is complementary to a nucleotide sequence of RNA encoded by a HCV target gene, or a portion thereof, and the sense region comprises a nucleotide sequence that is complementary to the antisense region. In one embodiment, the siNA molecule is assembled from two separate oligonucleotide fragments, wherein one fragment comprises the sense region and the second fragment comprises the antisense region of the siNA molecule. In another embodiment, the sense region is connected to the antisense region via a linker molecule. In another embodiment, the sense region is connected to the antisense region via a linker molecule, such as a nucleotide or non-nucleotide linker. In one embodiment, each strand of the double stranded siNA molecule comprises at least two (e.g., 2, 3, 4, 5, or more) different chemical modifications, e.g., different nucleotide sugar, base, or backbone modifications. The HCV target gene can comprise, for example, sequences referred herein or incorporated by reference herein In one embodiment, a siNA molecule of the invention comprises one or more (e.g., 1, 2, 3, 4, 5, 6, 7, 8, 9, 10, 11, 12, 13, 14, 15, 16, 17, 18, 19, 20 or more) 2'-deoxy-2'-fluoro pyrimidine modifications (e.g., where one or more or all pyrimidine (e.g., U or C) positions of the siNA are modified with 2'-deoxy-2'-fluoro nucleotides). In one embodiment, the 2'-deoxy-2'-fluoro pyrimidine modifications are present in the sense strand. In one embodiment, the 2'-deoxy-2'-fluoro pyrimidine modifications are present in the antisense strand. In one embodiment, the 2'-deoxy-2'-fluoro pyrimidine modifications are present in both the sense strand and the antisense strand of the siNA molecule.

In one embodiment, a siNA molecule of the invention comprises one or more (e.g., 1, 2, 3, 4, 5, 6, 7, 8, 9, 10, 11, 12, 13, 14, 15, 16, 17, 18, 19, 20 or more) 2'-O-methyl purine modifications (e.g., where one or more or all purine (e.g., A or G) positions of the siNA are modified with 2'-O-methyl nucleotides). In one embodiment, the 2'-O-methyl purine modifications are present in the sense strand. In one embodiment, the 2'-O-methyl purine modifications are present in the antisense strand. In one embodiment, the 2'-O-methyl purine modifications are present in both the sense strand and the antisense strand of the siNA molecule.

In one embodiment, a siNA molecule of the invention comprises one or more (e.g., 1, 2, 3, 4, 5, 6, 7, 8, 9, 10, 11, 12, 13, 14, 15, 16, 17, 18, 19, 20 or more) 2'-deoxy purine modifications (e.g., where one or more or all purine (e.g., A or G) positions of the siNA are modified with 2'-deoxy nucleotides). In one embodiment, the 2'-deoxy purine modifications are present in the sense strand. In one embodiment, the 2'-deoxy purine modifications are present in the antisense strand. In one embodiment, the 2'-deoxy purine modifications are present in both the sense strand and the antisense strand of the siNA molecule.

In one embodiment, the invention features a double-stranded short interfering nucleic acid (siNA) molecule that down-regulates expression of a HCV target gene or that directs cleavage of a HCV target RNA, comprising a sense region and an antisense region, wherein the antisense region comprises a nucleotide sequence that is complementary to a nucleotide sequence of RNA encoded by the HCV target gene or a portion thereof and the sense region comprises a nucleotide sequence that is complementary to the antisense region, and wherein the siNA molecule has one or more modified pyrimidine and/or purine nucleotides. In one embodiment, each strand of the double stranded siNA molecule comprises at least two (e.g., 2, 3, 4, 5, or more) different chemical modifications, e.g., different nucleotide sugar, base, or backbone modifications. In one embodiment, the pyrimidine nucleotides in the sense region are 2'-O-methylpyrimidine nucleotides or 2'-deoxy-2'-fluoro pyrimidine nucleotides and the purine nucleotides present in the sense region are 2'-deoxy purine nucleotides. In another embodiment, the pyrimidine nucleotides in the sense region are 2'-deoxy-2'-fluoro pyrimidine nucleotides and the purine nucleotides present in the sense region are 2'-O-methyl purine nucleotides. In another embodiment, the pyrimidine nucleotides in the sense region are 2'-deoxy-2'-fluoro pyrimidine nucleotides and the purine nucleotides present in the sense region are 2'-deoxy purine nucleotides. In one embodiment, the pyrimidine nucleotides in the antisense region are 2'-deoxy-2'-fluoro pyrimidine nucleotides and the purine nucleotides present in the antisense region are 2'-O-methyl or 2'-deoxy purine nucleotides. In another embodiment of any of the above-described siNA molecules, any nucleotides present in a non-complementary region of the sense strand (e.g. overhang region) are 2'-deoxy nucleotides.

In one embodiment, the invention features a double-stranded short interfering nucleic acid (siNA) molecule that down-regulates expression of a HCV target gene or that directs cleavage of a HCV target RNA, wherein the siNA molecule is assembled from two separate oligonucleotide fragments wherein one fragment comprises the sense region and the second fragment comprises the antisense region of the siNA molecule, and wherein the fragment comprising the sense region includes a terminal cap moiety at the 5'-end, the 3'-end, or both of the 5' and 3' ends of the fragment. In one embodiment, the terminal cap moiety is an inverted deoxy abasic moiety or glyceryl moiety. In one embodiment, each of the two fragments of the siNA molecule independently comprise about 15 to about 30 (e.g. about 15, 16, 17, 18, 19, 20, 21, 22, 23, 24, 25, 26, 27, 28, 29, or 30) nucleotides. In another embodiment, each of the two fragments of the siNA molecule independently comprise about 15 to about 40 (e.g. about 15, 16, 17, 18, 19, 20, 21, 22, 23, 24, 25, 26, 27, 28, 29, 30, 31, 23, 33, 34, 35, 36, 37, 38, 39, or 40) nucleotides. In a non-limiting example, each of the two fragments of the siNA molecule comprise about 21 nucleotides.

In one embodiment, the invention features a siNA molecule comprising at least one modified nucleotide, wherein the modified nucleotide is a 2'-deoxy-2'-fluoro nucleotide, 2'-deoxy-2'-fluoroarabino, 2'-O-trifluoromethyl nucleotide, 2'-O-ethyl-trifluoromethoxy nucleotide, or 2'-O-difluoromethoxy-ethoxy nucleotide or any other modified nucleoside/nucleotide described herein and in U.S. Ser. No. 10/981,966, filed Nov. 5, 2004, incorporated by reference herein. In one embodiment, the invention features a siNA molecule comprising at least two (e.g., 2, 3, 4, 5, 6, 7, 8, 9, 10, or more) modified nucleotides, wherein the modified nucleotide is selected from the group consisting of 2'-deoxy-2'-fluoro nucleotide, 2'-deoxy-2'-fluoroarabino, 2'-O-trifluoromethyl nucleotide, 2'-O-ethyl-trifluoromethoxy nucleotide, or 2'-O-difluoromethoxy-ethoxy nucleotide or any other modified nucleoside/nucleotide described herein and in U.S. Ser. No. 10/981,966, filed Nov. 5, 2004, incorporated by reference herein. The modified nucleotide/nucleoside can be the same or different. The siNA can be, for example, about 15 to about 40 nucleotides in length. In one embodiment, all pyrimidine nucleotides present in the siNA are 2'-deoxy-2'-fluoro, 2'-deoxy-2'-fluoroarabino, 2'-O-trifluoromethyl, 2'-O-ethyl-trifluoromethoxy, or 2'-O-difluoromethoxy-ethoxy, 4'-thio pyrimidine nucleotides.

In one embodiment, the invention features a method of increasing the stability of a siNA molecule against cleavage by ribonucleases comprising introducing at least one modified nucleotide into the siNA molecule, wherein the modified nucleotide is a 2'-deoxy-2'-fluoro nucleotide. In one embodiment, all pyrimidine nucleotides present in the siNA are 2'-deoxy-2'-fluoro pyrimidine nucleotides. In one embodiment, the modified nucleotides in an siNA of the invention include at least one 2'-deoxy-2'-fluoro cytidine or 2'-deoxy-2'-fluoro uridine nucleotide. In another embodiment, the modified nucleotides in the siNA include at least one 2'-fluoro cytidine and at least one 2'-deoxy-2'-fluoro uridine nucleotides. In one embodiment, all uridine nucleotides present in the siNA are 2'-deoxy-2'-fluoro uridine nucleotides. In one embodiment, all cytidine nucleotides present in the siNA are 2'-deoxy-2'-fluoro cytidine nucleotides. In one embodiment, all adenosine nucleotides present in the siNA are 2'-deoxy-2'-fluoro adenosine nucleotides. In one embodiment, all guanosine nucleotides present in the siNA are 2'-deoxy-2'-fluoro guanosine nucleotides. The siNA can further comprise at least one modified internucleotidic linkage, such as a phosphorothioate linkage. In one embodiment, the 2'-deoxy-2'-fluoronucleotides are present at specifically selected locations in the siNA that are sensitive to cleavage by ribonucleases, such as locations having pyrimidine nucleotides.

In one embodiment, the invention features a method of increasing the stability of a siNA molecule against cleavage by ribonucleases comprising introducing at least one modified nucleotide into the siNA molecule, wherein the modified nucleotide is a 2'-deoxy-2'-fluoroarabino nucleotide. In one embodiment, all pyrimidine nucleotides present in the siNA are 2'-deoxy-2'-fluoroarabino pyrimidine nucleotides. In one embodiment, the modified nucleotides in the siNA include at least one 2'-deoxy-2'-fluoroarabino cytidine or 2'-deoxy-2'-fluoroarabino uridine nucleotide. In another embodiment, the modified nucleotides in the siNA include at least one 2'-fluoro cytidine and at least one 2'-deoxy-2'-fluoroarabino uridine nucleotides. In one embodiment, all uridine nucleotides present in the siNA are 2'-deoxy-2'-fluoroarabino uridine nucleotides. In one embodiment, all cytidine nucleotides present in the siNA are 2'-deoxy-2'-fluoroarabino cytidine nucleotides. In one embodiment, all adenosine nucleotides present in the siNA are 2'-deoxy-2'-fluoroarabino adenosine nucleotides. In one embodiment, all guanosine nucleotides present in the siNA are 2'-deoxy-2'-fluoroarabino guanosine nucleotides. The siNA can further comprise at least one modified internucleotidic linkage, such as a phosphorothioate linkage. In one embodiment, the 2'-deoxy-2'-fluoroarabinonucleotides are present at specifically selected locations in the siNA that are sensitive to cleavage by ribonucleases, such as locations having pyrimidine nucleotides.

In one embodiment, the invention features a double-stranded short interfering nucleic acid (siNA) molecule that down-regulates expression of a HCV target gene or that directs cleavage of a HCV target RNA, comprising a sense region and an antisense region, wherein the antisense region comprises a nucleotide sequence that is complementary to a nucleotide sequence of RNA encoded by the HCV target gene or a portion thereof and the sense region comprises a nucleotide sequence that is complementary to the antisense region, and wherein the purine nucleotides present in the antisense region comprise 2'-deoxy-purine nucleotides. In an alternative embodiment, the purine nucleotides present in the antisense region comprise 2'-O-methyl purine nucleotides. In either of the above embodiments, the antisense region can comprise a phosphorothioate internucleotide linkage at the 3' end of the antisense region. Alternatively, in either of the above embodiments, the antisense region can comprise a glyceryl modification at the 3' end of the antisense region. In another embodiment of any of the above-described siNA molecules, any nucleotides present in a non-complementary region of the antisense strand (e.g. overhang region) are 2'-deoxy nucleotides.

In one embodiment, the antisense region of a siNA molecule of the invention comprises sequence complementary to a portion of an endogenous transcript having sequence unique to a particular disease or trait related allele in a subject or organism, such as sequence comprising a single nucleotide polymorphism (SNP) associated with the disease or trait specific allele. As such, the antisense region of a siNA molecule of the invention can comprise sequence complementary to sequences that are unique to a particular allele to provide specificity in mediating selective RNAi against the disease, condition, or trait related allele.

In one embodiment, the invention features a double-stranded short interfering nucleic acid (siNA) molecule that down-regulates expression of a HCV target gene or that directs cleavage of a HCV target RNA, wherein the siNA molecule is assembled from two separate oligonucleotide fragments wherein one fragment comprises the sense region and the second fragment comprises the antisense region of the siNA molecule. In one embodiment, each strand of the double stranded siNA molecule is about 21 nucleotides long where about 19 nucleotides of each fragment of the siNA molecule are base-paired to the complementary nucleotides of the other fragment of the siNA molecule, wherein at least two 3' terminal nucleotides of each fragment of the siNA molecule are not base-paired to the nucleotides of the other fragment of the siNA molecule. In another embodiment, the siNA molecule is a double stranded nucleic acid molecule, where each strand is about 19 nucleotide long and where the nucleotides of each fragment of the siNA molecule are base-paired to the complementary nucleotides of the other fragment of the siNA molecule to form at least about 15 (e.g., 15, 16, 17, 18, or 19) base pairs, wherein one or both ends of the siNA molecule are blunt ends. In one embodiment, each of the two 3' terminal nucleotides of each fragment of the siNA molecule is a 2'-deoxy-pyrimidine nucleotide, such as a 2'-deoxy-thymidine. In one embodiment, each of the two 3' terminal nucleotides of each fragment of the siNA molecule is a 2'-O-methylpyrimidine nucleotide, such as a 2'-O-methyl uridine, cytidine, or thymidine. In another embodiment, all nucleotides of each fragment of the siNA molecule are base-paired to the complementary nucleotides of the other fragment of the siNA molecule. In another embodiment, the siNA molecule is a double stranded nucleic acid molecule of about 19 to about 25 base pairs having a sense region and an antisense region, where about 19 nucleotides of the antisense region are base-paired to the nucleotide sequence or a portion thereof of the RNA encoded by the HCV target gene. In another embodiment, about 21 nucleotides of the antisense region are base-paired to the nucleotide sequence or a portion thereof of the RNA encoded by the HCV target gene. In any of the above embodiments, the 5'-end of the fragment comprising said antisense region can optionally include a phosphate group.

In one embodiment, the invention features a double-stranded short interfering nucleic acid (siNA) molecule that inhibits the expression of a HCV target RNA sequence, wherein the siNA molecule does not contain any ribonucleotides and wherein each strand of the double-stranded siNA molecule is about 15 to about 30 nucleotides. In one embodiment, the siNA molecule is 21 nucleotides in length. Examples of non-ribonucleotide containing siNA constructs are combinations of stabilization chemistries shown in Table IV in any combination of Sense/Antisense chemistries, such as Stab 7/8, Stab 7/11, Stab 8/8, Stab 18/8, Stab 18/11, Stab 12/13, Stab 7/13, Stab 18/13, Stab 7/19, Stab 8/19, Stab 18/19, Stab 7/20, Stab 8/20, Stab 18/20, Stab 7/32, Stab 8/32, or Stab 18/32 (e.g., any siNA having Stab 7, 8, 11, 12, 13, 14, 15, 17, 18, 19, 20, or 32 sense or antisense strands or any combination thereof). Herein, numeric Stab chemistries can include both 2'-fluoro and 2'-OCF$_3$ versions of the chemistries shown in Table IV. For example, "Stab 7/8" refers to both Stab 7/8 and Stab 7F/8F etc. In one embodiment, the invention features a chemically synthesized double stranded RNA molecule that directs cleavage of a HCV target RNA via RNA interference, wherein each strand of said RNA molecule is about 15 to about 30 nucleotides in length; one strand of the RNA molecule comprises nucleotide sequence having sufficient complementarity to the HCV target RNA for the RNA molecule to direct cleavage of the HCV target RNA via RNA interference; and wherein at least one strand of the RNA molecule optionally comprises one or more chemically modified nucleotides described herein, such as without limitation deoxynucleotides, 2'-O-methyl nucleotides, 2'-deoxy-2'-fluoro nucleotides, 2'-deoxy-2'-fluoroarabino, 2'-O-methoxyethyl nucleotides, 4'-thio nucleotides, 2'-O-trifluoromethyl nucleotides, 2'-O-ethyl-trifluoromethoxy nucleotides, 2'-O-difluoromethoxy-ethoxy nucleotides, etc. or any combination thereof.

In one embodiment, a HCV target RNA of the invention comprises sequence encoding a protein, such as an HCV or HCV pathway/host RNA encoding a HCV or HCV pathway/host protein.

In one embodiment, target RNA of the invention comprises non-coding RNA sequence (e.g., miRNA, snRNA, siRNA etc.), see for example Mattick, 2005, *Science,* 309, 1527-1528; Claverie, 2005, *Science,* 309, 1529-1530; Sethupathy et al., 2006, *RNA,* 12, 192-197; and Czech, 2006NEJM, 354, 11: 1194-1195.

In one embodiment, the invention features a medicament comprising a siNA molecule of the invention.

In one embodiment, the invention features an active ingredient comprising a siNA molecule of the invention.

In one embodiment, the invention features the use of a double-stranded short interfering nucleic acid (siNA) molecule to inhibit, down-regulate, or reduce expression of a HCV target gene, wherein the siNA molecule comprises one or more chemical modifications and each strand of the double-stranded siNA is independently about 15 to about 30 or more (e.g., about 15, 16, 17, 18, 19, 20, 21, 22, 23, 24, 25, 26, 27, 28, 29 or 30 or more) nucleotides long. In one embodiment, the siNA molecule of the invention is a double stranded nucleic acid molecule comprising one or more chemical modifications, where each of the two fragments of the siNA molecule independently comprise about 15 to about 40 (e.g. about 15, 16, 17, 18, 19, 20, 21, 22, 23, 24, 25, 26, 27, 28, 29, 30, 31, 23, 33, 34, 35, 36, 37, 38, 39, or 40) nucleotides and where one of the strands comprises at least 15 nucleotides that are complementary to nucleotide sequence of HCV target encoding RNA or a portion thereof. In a non-limiting example, each of the two fragments of the siNA molecule comprise about 21 nucleotides. In another embodiment, the siNA molecule is a double stranded nucleic acid molecule comprising one or more chemical modifications, where each strand is about 21 nucleotide long and where about 19 nucleotides of each fragment of the siNA molecule are base-paired to the complementary nucleotides of the other fragment of the siNA molecule, wherein at least two 3' terminal nucleotides of each fragment of the siNA molecule are not base-paired to the nucleotides of the other fragment of the siNA molecule. In another embodiment, the siNA molecule is a double stranded nucleic acid molecule comprising one or more chemical modifications, where each strand is about 19 nucleotide long and where the nucleotides of each fragment of the siNA molecule are base-paired to the complementary nucleotides of the other fragment of the siNA molecule to form at least about 15 (e.g., 15, 16, 17, 18, or 19) base pairs, wherein one or both ends of the siNA molecule are blunt ends. In one embodiment, each of the two 3' terminal nucleotides of each fragment of the siNA molecule is a 2'-deoxy-pyrimidine nucleotide, such as a 2'-deoxy-thymidine. In one embodiment, each of the two 3' terminal nucleotides of each fragment of the siNA molecule is a 2'-O-methylpyrimidine nucleotide, such as a 2'-O-methyl uridine, cytidine, or thymidine. In another embodiment, all nucleotides of each fragment of the siNA molecule are base-paired to the complementary nucleotides of the other fragment of the siNA molecule. In another embodiment, the siNA molecule is a double stranded nucleic acid molecule of about 19 to about 25 base pairs having a sense region and an antisense region and comprising one or more chemical modifications, where about 19 nucleotides of the antisense region are base-paired to the nucleotide sequence or a portion thereof of the RNA encoded by the HCV target gene. In another embodiment, about 21 nucleotides of the antisense region are base-paired to the nucleotide sequence or a portion thereof of the RNA encoded by the HCV target gene. In any of the above embodiments, the 5'-end of the fragment comprising said antisense region can optionally include a phosphate group.

In one embodiment, the invention features the use of a double-stranded short interfering nucleic acid (siNA) molecule that inhibits, down-regulates, or reduces expression of a HCV target gene, wherein one of the strands of the double-stranded siNA molecule is an antisense strand which comprises nucleotide sequence that is complementary to nucleotide sequence of HCV target RNA or a portion thereof, the other strand is a sense strand which comprises nucleotide sequence that is complementary to a nucleotide sequence of the antisense strand. In one embodiment, each strand has at least two (e.g., 2, 3, 4, 5, or more) chemical modifications, which can be the same or different, such as nucleotide, sugar, base, or backbone modifications. In one embodiment, a majority of the pyrimidine nucleotides present in the double-stranded siNA molecule comprises a sugar modification. In one embodiment, a majority of the purine nucleotides present in the double-stranded siNA molecule comprises a sugar modification.

In one embodiment, the invention features a double-stranded short interfering nucleic acid (siNA) molecule that inhibits, down-regulates, or reduces expression of a HCV target gene, wherein one of the strands of the double-stranded siNA molecule is an antisense strand which comprises nucleotide sequence that is complementary to nucleotide sequence of HCV target RNA that encodes a protein or portion thereof, the other strand is a sense strand which comprises nucleotide sequence that is complementary to a nucleotide sequence of the antisense strand and wherein a majority of the pyrimidine nucleotides present in the double-stranded siNA molecule comprises a sugar modification. In one embodiment, each strand of the siNA molecule comprises about 15 to about 30 or more (e.g., about 15, 16, 17, 18, 19, 20, 21, 22, 23, 24, 25, 26, 27, 28, 29, or 30 or more) nucleotides, wherein each strand comprises at least about 15 nucleotides that are complementary to the nucleotides of the other strand. In one embodiment, the siNA molecule is assembled from two oligonucleotide fragments, wherein one fragment comprises the nucleotide sequence of the antisense strand of the siNA molecule and a second fragment comprises nucleotide sequence of the sense region of the siNA molecule. In one embodiment, the sense strand is connected to the antisense strand via a linker molecule, such as a polynucleotide linker or a non-nucleotide linker. In a further embodiment, the pyrimidine nucleotides present in the sense strand are 2'-deoxy-2'fluoro pyrimidine nucleotides and the purine nucleotides present in the sense region are 2'-deoxy purine nucleotides. In another embodiment, the pyrimidine nucleotides present in the sense strand are 2'-deoxy-2'fluoro pyrimidine nucleotides and the purine nucleotides present in the sense region are 2'-O-methyl purine nucleotides. In still another embodiment, the pyrimidine nucleotides present in the antisense strand are 2'-deoxy-2'-fluoro pyrimidine nucleotides and any purine nucleotides present in the antisense strand are 2'-deoxy purine nucleotides. In another embodiment, the antisense strand comprises one or more 2'-deoxy-2'-fluoro pyrimidine nucleotides and one or more 2'-O-methyl purine nucleotides. In another embodiment, the pyrimidine nucleotides present in the antisense strand are 2'-deoxy-2'-fluoro pyrimidine nucleotides and any purine nucleotides present in the antisense strand are 2'-O-methyl purine nucleotides. In a further embodiment the sense strand comprises a 3'-end and a 5'-end, wherein a terminal cap moiety (e.g., an inverted deoxy abasic moiety or inverted deoxy nucleotide moiety such as inverted thymidine) is present at the 5'-end, the 3'-end, or both of the 5' and 3' ends of the sense strand. In another embodiment, the antisense strand comprises a phosphorothioate internucleotide linkage at the 3' end of the antisense strand. In another embodiment, the antisense strand comprises a glyceryl modification at the 3' end. In another embodiment, the 5'-end of the antisense strand optionally includes a phosphate group.

In any of the above-described embodiments of a double-stranded short interfering nucleic acid (siNA) molecule that inhibits expression of a HCV target gene, wherein a majority of the pyrimidine nucleotides present in the double-stranded siNA molecule comprises a sugar modification, each of the two strands of the siNA molecule can comprise about 15 to about 30 or more (e.g., about 15, 16, 17, 18, 19, 20, 21, 22, 23, 24, 25, 26, 27, 28, 29, or 30 or more) nucleotides. In one embodiment, about 15 to about 30 or more (e.g., about 15, 16, 17, 18, 19, 20, 21, 22, 23, 24, 25, 26, 27, 28, 29, or 30 or more) nucleotides of each strand of the siNA molecule are base-paired to the complementary nucleotides of the other strand of the siNA molecule. In another embodiment, about 15 to about 30 or more (e.g., about 15, 16, 17, 18, 19, 20, 21, 22, 23, 24, 25, 26, 27, 28, 29, or 30 or more) nucleotides of each strand of the siNA molecule are base-paired to the complementary nucleotides of the other strand of the siNA molecule, wherein at least two 3' terminal nucleotides of each strand of the siNA molecule are not base-paired to the nucleotides of the other strand of the siNA molecule. In another embodiment, each of the two 3' terminal nucleotides of each fragment of the siNA molecule is a 2'-deoxy-pyrimidine, such as 2'-deoxy-thymidine. In one embodiment, each strand of the siNA molecule is base-paired to the complementary nucleotides of the other strand of the siNA molecule. In one embodiment, about 15 to about 30 (e.g., about 15, 16, 17, 18, 19, 20, 21, 22, 23, 24, 25, 26, 27, 28, 29, or 30) nucleotides of the antisense strand are base-paired to the nucleotide sequence of the HCV target RNA or a portion thereof. In one embodiment, about 18 to about 25 (e.g., about 18, 19, 20, 21, 22, 23, 24, or 25) nucleotides of the antisense strand are base-paired to the nucleotide sequence of the HCV target RNA or a portion thereof.

In one embodiment, the invention features a double-stranded short interfering nucleic acid (siNA) molecule that inhibits expression of a HCV target gene, wherein one of the strands of the double-stranded siNA molecule is an antisense strand which comprises nucleotide sequence that is complementary to nucleotide sequence of HCV target RNA or a portion thereof, the other strand is a sense strand which comprises nucleotide sequence that is complementary to a nucleotide sequence of the antisense strand. In one embodiment, each strand has at least two (e.g., 2, 3, 4, 5, or more) different chemical modifications, such as nucleotide sugar, base, or backbone modifications. In one embodiment, a majority of the pyrimidine nucleotides present in the double-stranded siNA molecule comprises a sugar modification. In one embodiment, a majority of the purine nucleotides present in the double-stranded siNA molecule comprises a sugar modification. In one embodiment, the 5'-end of the antisense strand optionally includes a phosphate group.

In one embodiment, the invention features a double-stranded short interfering nucleic acid (siNA) molecule that inhibits expression of a HCV target gene, wherein one of the strands of the double-stranded siNA molecule is an antisense strand which comprises nucleotide sequence that is complementary to nucleotide sequence of HCV target RNA or a portion thereof, the other strand is a sense strand which comprises nucleotide sequence that is complementary to a nucleotide sequence of the antisense strand and wherein a majority of the pyrimidine nucleotides present in the double-stranded siNA molecule comprises a sugar modification, and wherein the nucleotide sequence or a portion thereof of the antisense strand is complementary to a nucleotide sequence of the untranslated region or a portion thereof of the HCV target RNA.

In one embodiment, the invention features a double-stranded short interfering nucleic acid (siNA) molecule that inhibits expression of a HCV target gene, wherein one of the strands of the double-stranded siNA molecule is an antisense strand which comprises nucleotide sequence that is complementary to nucleotide sequence of HCV target RNA or a portion thereof, wherein the other strand is a sense strand which comprises nucleotide sequence that is complementary to a nucleotide sequence of the antisense strand, wherein a majority of the pyrimidine nucleotides present in the double-stranded siNA molecule comprises a sugar modification, and wherein the nucleotide sequence of the antisense strand is complementary to a nucleotide sequence of the HCV target RNA or a portion thereof that is present in the HCV target RNA.

In one embodiment, the invention features a composition comprising a siNA molecule of the invention in a pharmaceutically acceptable carrier or diluent. In another embodiment, the invention features two or more differing siNA molecules of the invention (e.g. siNA molecules that target different regions of HCV target RNA or siNA molecules that target HCV RNA and cellular targets) in a pharmaceutically acceptable carrier or diluent.

In a non-limiting example, the introduction of chemically-modified nucleotides into nucleic acid molecules provides a powerful tool in overcoming potential limitations of in vivo stability and bioavailability inherent to native RNA molecules that are delivered exogenously. For example, the use of chemically-modified nucleic acid molecules can enable a lower dose of a particular nucleic acid molecule for a given therapeutic effect since chemically-modified nucleic acid molecules tend to have a longer half-life in serum. Furthermore, certain chemical modifications can improve the bioavailability of nucleic acid molecules by HCV targeting particular cells or tissues and/or improving cellular uptake of the nucleic acid molecule. Therefore, even if the activity of a chemically-modified nucleic acid molecule is reduced as compared to a native nucleic acid molecule, for example, when compared to an all-RNA nucleic acid molecule, the overall activity of the modified nucleic acid molecule can be greater than that of the native molecule due to improved stability and/or delivery of the molecule. Unlike native unmodified siNA, chemically-modified siNA can also minimize the possibility of activating interferon activity or immunostimulation in humans. These properties therefore improve upon native siRNA or minimally modified siRNA's ability to mediate RNAi in various in vitro and in vivo settings, including use in both research and therapeutic applications. Applicant describes herein chemically modified siNA molecules with improved RNAi activity compared to corresponding unmodified or minimally modified siRNA molecules. The chemically modified siNA motifs disclosed herein provide the capacity to maintain RNAi activity that is substantially similar to unmodified or minimally modified active siRNA (see for example Elbashir et al., 2001, EMBO J., 20:6877-6888) while at the same time providing nuclease resistance and pharmacoketic properties suitable for use in therapeutic applications.

In any of the embodiments of siNA molecules described herein, the antisense region of a siNA molecule of the invention can comprise a phosphorothioate internucleotide linkage at the 3'-end of said antisense region. In any of the embodiments of siNA molecules described herein, the antisense region can comprise about one to about five phosphorothioate internucleotide linkages at the 5'-end of said antisense region. In any of the embodiments of siNA molecules described herein, the 3'-terminal nucleotide overhangs of a siNA molecule of the invention can comprise ribonucleotides or deoxyribonucleotides that are chemically-modified at a nucleic acid sugar, base, or backbone. In any of the embodiments of siNA molecules described herein, the 3'-terminal nucleotide overhangs can comprise one or more universal base ribonucleotides. In any of the embodiments of siNA molecules described herein, the 3'-terminal nucleotide overhangs can comprise one or more acyclic nucleotides.

One embodiment of the invention provides an expression vector comprising a nucleic acid sequence encoding at least one siNA molecule of the invention in a manner that allows expression of the nucleic acid molecule. Another embodiment of the invention provides a mammalian cell comprising such an expression vector. The mammalian cell can be a human cell. The siNA molecule of the expression vector can comprise a sense region and an antisense region. The antisense region can comprise sequence complementary to a RNA or DNA sequence encoding a HCV target and the sense region can comprise sequence complementary to the antisense region. The siNA molecule can comprise two distinct strands having complementary sense and antisense regions. The siNA molecule can comprise a single strand having complementary sense and antisense regions.

In one embodiment, the invention features a chemically-modified short interfering nucleic acid (siNA) molecule capable of mediating RNA interference (RNAi) inside a cell or reconstituted in vitro system, wherein the chemical modification comprises one or more (e.g., about 1, 2, 3, 4, 5, 6, 7, 8, 9, 10, or more) nucleotides comprising a backbone modified internucleotide linkage having Formula I:

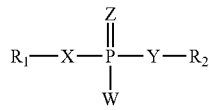

wherein each R1 and R2 is independently any nucleotide, non-nucleotide, or polynucleotide which can be naturally-occurring or chemically-modified and which can be included in the structure of the siNA molecule or serve as a point of attachment to the siNA molecule, each X and Y is independently O, S, N, alkyl, or substituted alkyl, each Z and W is independently O, S, N, alkyl, substituted alkyl, O-alkyl, S-alkyl, alkaryl, aralkyl, or acetyl and wherein W, X, Y, and Z are optionally not all O. In another embodiment, a backbone modification of the invention comprises a phosphonoacetate and/or thiophosphonoacetate internucleotide linkage (see for example Sheehan et al., 2003, Nucleic Acids Research, 31, 4109-4118).

The chemically-modified internucleotide linkages having Formula I, for example, wherein any Z, W, X, and/or Y independently comprises a sulphur atom, can be present in one or both oligonucleotide strands of the siNA duplex, for example, in the sense strand, the antisense strand, or both strands. The siNA molecules of the invention can comprise one or more (e.g., about 1, 2, 3, 4, 5, 6, 7, 8, 9, 10, or more) chemically-modified internucleotide linkages having Formula I at the 3'-end, the 5'-end, or both of the 3' and 5'-ends of the sense strand, the antisense strand, or both strands. For example, an exemplary siNA molecule of the invention can comprise about 1 to about 5 or more (e.g., about 1, 2, 3, 4, 5, or more) chemically-modified internucleotide linkages having Formula I at the 5'-end of the sense strand, the antisense strand, or both strands. In another non-limiting example, an exemplary siNA molecule of the invention can comprise one or more (e.g., about 1, 2, 3, 4, 5, 6, 7, 8, 9, 10, or more) pyrimidine nucleotides with chemically-modified internucleotide linkages having Formula I in the sense strand, the antisense strand, or both strands. In yet another non-limiting example, an exemplary siNA molecule of the invention can comprise one or more (e.g., about 1, 2, 3, 4, 5, 6, 7, 8, 9, 10, or more) purine nucleotides with chemically-modified internucleotide linkages having Formula I in the sense strand, the antisense strand, or both strands. In another embodiment, a siNA molecule of the invention having internucleotide linkage(s) of Formula I also comprises a chemically-modified nucleotide or non-nucleotide having any of Formulae I-VII.

In one embodiment, the invention features a chemically-modified short interfering nucleic acid (siNA) molecule capable of mediating RNA interference (RNAi) inside a cell or reconstituted in vitro system, wherein the chemical modification comprises one or more (e.g., about 1, 2, 3, 4, 5, 6, 7, 8, 9, 10, or more) nucleotides or non-nucleotides having Formula II:

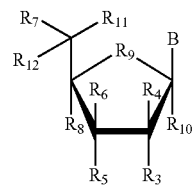

wherein each R3, R4, R5, R6, R7, R8, R10, R11 and R12 is independently H, OH, alkyl, substituted alkyl, alkaryl or aralkyl, F, Cl, Br, CN, CF3, OCF3, OCH3, OCN, O-alkyl, S-alkyl, N-alkyl, O-alkenyl, S-alkenyl, N-alkenyl, SO-alkyl, alkyl-OSH, alkyl-OH, O-alkyl-OH, O-alkyl-SH, S-alkyl-OH, S-alkyl-SH, alkyl-S-alkyl, alkyl-O-alkyl, ONO2, NO2, N3, NH2, aminoalkyl, aminoacid, aminoacyl, ONH2, O-aminoalkyl, O-aminoacid, O-aminoacyl, heterocycloalkyl, heterocycloalkaryl, aminoalkylamino, polyalklylamino, substituted silyl, or a group having any of Formula I, II, III, IV, V, VI and/or VII, any of which can be included in the structure of the siNA molecule or serve as a point of attachment to the siNA molecule; R9 is O, S, CH2, S=O, CHF, or CF2, and B is a nucleosidic base such as adenine, guanine, uracil, cytosine, thymine, 2-aminoadenosine, 5-methylcytosine, 2,6-diaminopurine, or any other non-naturally occurring base that can be complementary or non-complementary to target RNA or a non-nucleosidic base such as phenyl, naphthyl, 3-nitropyrrole, 5-nitroindole, nebularine, pyridone, pyridinone, or any other non-naturally occurring universal base that can be complementary or non-complementary to target RNA. In one embodiment, R3 and/or R7 comprises a conjugate moiety and a linker (e.g., a nucleotide or non-nucleotide linker as described herein or otherwise known in the art). Non-limiting examples of conjugate moieties include ligands for cellular receptors, such as peptides derived from naturally occurring protein ligands; protein localization sequences, including cellular ZIP code sequences; antibodies; nucleic acid aptamers; vitamins and other co-factors, such as folate and N-acetylgalactosamine; polymers, such as polyethyleneglycol (PEG); phospholipids; cholesterol; steroids, and polyamines, such as PEI, spermine or spermidine. In one embodiment, a nucleotide of the invention having Formula II is a 2'-deoxy-2'-fluoro nucleotide. In one embodiment, a nucleotide of the invention having Formula II is a 2'-O-methyl nucleotide. In one embodiment, a nucleotide of the invention having, Formula II is a 2'-deoxy nucleotide.

The chemically-modified nucleotide or non-nucleotide of Formula II can be present in one or both oligonucleotide strands of the siNA duplex, for example in the sense strand, the antisense strand, or both strands. The siNA molecules of the invention can comprise one or more chemically-modified nucleotides or non-nucleotides of Formula II at the 3'-end, the 5'-end, or both of the 3' and 5'-ends of the sense strand, the antisense strand, or both strands. For example, an exemplary siNA molecule of the invention can comprise about 1 to about 5 or more (e.g., about 1, 2, 3, 4, 5, or more) chemically-modified nucleotides or non-nucleotides of Formula II at the 5'-end of the sense strand, the antisense strand, or both strands. In another non-limiting example, an exemplary siNA molecule of the invention can comprise about 1 to about 5 or more (e.g., about 1, 2, 3, 4, 5, or more) chemically-modified nucleotides or non-nucleotides of Formula II at the 3'-end of the sense strand, the antisense strand, or both strands.

In one embodiment, the invention features a chemically-modified short interfering nucleic acid (siNA) molecule capable of mediating RNA interference (RNAi) inside a cell or reconstituted in vitro system, wherein the chemical modification comprises one or more (e.g., about 1, 2, 3, 4, 5, 6, 7, 8, 9, 10, or more) nucleotides or non-nucleotides having Formula III:

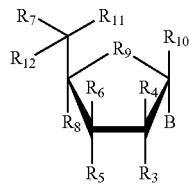

wherein each R3, R4, R5, R6, R7, R8, R10, R11 and R12 is independently H, OH, alkyl, substituted alkyl, alkaryl or aralkyl, F, Cl, Br, CN, CF3, OCF3, OCH3, OCN, O-alkyl, S-alkyl, N-alkyl, O-alkenyl, S-alkenyl, N-alkenyl, SO-alkyl, alkyl-OSH, alkyl-OH, O-alkyl-OH, O-alkyl-SH, S-alkyl-OH, S-alkyl-SH, alkyl-S-alkyl, alkyl-O-alkyl, ONO2, NO2, N3, NH2, aminoalkyl, aminoacid, aminoacyl, ONH2, O-aminoalkyl, O-aminoacid, O-aminoacyl, heterocycloalkyl, heterocycloalkaryl, aminoalkylamino, polyalklylamino, substituted silyl, or a group having any of Formula I, II, III, IV, V, VI and/or VII, any of which can be included in the structure of the siNA molecule or serve as a point of attachment to the siNA molecule; R9 is O, S, CH2, S=O, CHF, or CF2, and B is a nucleosidic base such as adenine, guanine, uracil, cytosine, thymine, 2-aminoadenosine, 5-methylcytosine, 2,6-diaminopurine, or any other non-naturally occurring base that can be employed to be complementary or non-complementary to target RNA or a non-nucleosidic base such as phenyl, naphthyl, 3-nitropyrrole, 5-nitroindole, nebularine, pyridone, pyridinone, or any other non-naturally occurring universal base that can be complementary or non-complementary to target RNA. In one embodiment, R3 and/or R7 comprises a conjugate moiety and a linker (e.g., a nucleotide or non-nucleotide linker as described herein or otherwise known in the art). Non-limiting examples of conjugate moieties include ligands for cellular receptors, such as peptides derived from naturally occurring protein ligands; protein localization sequences, including cellular ZIP code sequences; antibodies; nucleic acid aptamers; vitamins and other co-factors, such as folate and N-acetylgalactosamine; polymers, such as polyethyleneglycol (PEG); phospholipids; cholesterol; steroids, and polyamines, such as PEI, spermine or spermidine.

The chemically-modified nucleotide or non-nucleotide of Formula III can be present in one or both oligonucleotide strands of the siNA duplex, for example, in the sense strand, the antisense strand, or both strands. The siNA molecules of the invention can comprise one or more chemically-modified nucleotides or non-nucleotides of Formula III at the 3'-end, the 5'-end, or both of the 3' and 5'-ends of the sense strand, the antisense strand, or both strands. For example, an exemplary siNA molecule of the invention can comprise about 1 to about 5 or more (e.g., about 1, 2, 3, 4, 5, or more) chemically-modified nucleotide(s) or non-nucleotide(s) of Formula III at the 5'-end of the sense strand, the antisense strand, or both strands. In another non-limiting example, an exemplary siNA molecule of the invention can comprise about 1 to about 5 or more (e.g., about 1, 2, 3, 4, 5, or more) chemically-modified nucleotide or non-nucleotide of Formula III at the 3'-end of the sense strand, the antisense strand, or both strands.

In another embodiment, a siNA molecule of the invention comprises a nucleotide having Formula II or III, wherein the nucleotide having Formula II or III is in an inverted configuration. For example, the nucleotide having Formula II or III is connected to the siNA construct in a 3'-3',3'-2',2'-3', or 5'-5' configuration, such as at the 3'-end, the 5'-end, or both of the 3' and 5'-ends of one or both siNA strands.

In one embodiment, the invention features a chemically-modified short interfering nucleic acid (siNA) molecule capable of mediating RNA interference (RNAi) inside a cell or reconstituted in vitro system, wherein the chemical modification comprises a 5'-terminal phosphate group having Formula IV:

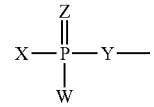

wherein each X and Y is independently O, S, N, alkyl, substituted alkyl, or alkylhalo; wherein each Z and W is independently O, S, N, alkyl, substituted alkyl, O-alkyl, S-alkyl, alkaryl, aralkyl, alkylhalo, or acetyl; and wherein W, X, Y and Z are optionally not all O and Y serves as a point of attachment to the siNA molecule.

In one embodiment, the invention features a siNA molecule having a 5'-terminal phosphate group having Formula IV on the HCV target-complementary strand, for example, a strand complementary to a HCV target RNA, wherein the siNA molecule comprises an all RNA siNA molecule. In another embodiment, the invention features a siNA molecule having a 5'-terminal phosphate group having Formula IV on the HCV target-complementary strand wherein the siNA molecule also comprises about 1 to about 3 (e.g., about 1, 2, or 3) nucleotide 3'-terminal nucleotide overhangs having about 1 to about 4 (e.g., about 1, 2, 3, or 4) deoxyribonucleotides on the 3'-end of one or both strands. In another embodiment, a 5'-terminal phosphate group having Formula IV is present on the HCV target-complementary strand of a siNA molecule of the invention, for example a siNA molecule having chemical modifications having any of Formulae I-VII.

In one embodiment, the invention features a chemically-modified short interfering nucleic acid (siNA) molecule capable of mediating RNA interference (RNAi) inside a cell or reconstituted in vitro system, wherein the chemical modification comprises one or more phosphorothioate internucleotide linkages. For example, in a non-limiting example, the invention features a chemically-modified short interfering nucleic acid (siNA) having about 1, 2, 3, 4, 5, 6, 7, 8 or more phosphorothioate internucleotide linkages in one siNA strand. In yet another embodiment, the invention features a chemically-modified short interfering nucleic acid (siNA) individually having about 1, 2, 3, 4, 5, 6, 7, 8 or more phosphorothioate internucleotide linkages in both siNA strands.

The phosphorothioate internucleotide linkages can be present in one or both oligonucleotide strands of the siNA duplex, for example in the sense strand, the antisense strand, or both strands. The siNA molecules of the invention can comprise one or more phosphorothioate internucleotide linkages at the 3'-end, the 5'-end, or both of the 3'- and 5'-ends of the sense strand, the antisense strand, or both strands. For example, an exemplary siNA molecule of the invention can comprise about 1 to about 5 or more (e.g., about 1, 2, 3, 4, 5, or more) consecutive phosphorothioate internucleotide linkages at the 5'-end of the sense strand, the antisense strand, or both strands. In another non-limiting example, an exemplary siNA molecule of the invention can comprise one or more (e.g., about 1, 2, 3, 4, 5, 6, 7, 8, 9, 10, or more) pyrimidine phosphorothidate internucleotide linkages in the sense strand, the antisense strand, or both strands. In yet another non-limiting example, an exemplary siNA molecule of the invention can comprise one or more (e.g., about 1, 2, 3, 4, 5, 6, 7, 8, 9, 10, or more) purine phosphorothioate internucleotide linkages in the sense strand, the antisense strand, or both strands.

Each strand of the double stranded siNA molecule can have one or more chemical modifications such that each strand comprises a different pattern of chemical modifications. Several non-limiting examples of modification schemes that could give rise to different patterns of modifications are provided herein.

In one embodiment, the invention features a siNA molecule, wherein the sense strand comprises one or more, for example, about 1, 2, 3, 4, 5, 6, 7, 8, 9, 10, or more phosphorothioate internucleotide linkages, and/or one or more (e.g., about 1, 2, 3, 4, 5, 6, 7, 8, 9, 10 or more) 2'-deoxy, 2'-O-methyl, 2'-deoxy-2'-fluoro, 2'-O-trifluoromethyl, 2'-O-ethyl-trifluoromethoxy, 2'-O-difluoromethoxy-ethoxy and/or about one or more (e.g., about 1, 2, 3, 4, 5, 6, 7, 8, 9, 10 or more) universal base modified nucleotides, and optionally a terminal cap molecule at the 3'-end, the 5'-end, or both of the 3'- and 5'-ends of the sense strand; and wherein the antisense strand comprises about 1 to about 10 or more, specifically about 1, 2, 3, 4, 5, 6, 7, 8, 9, 10, or more phosphorothioate internucleotide linkages, and/or one or more (e.g., about 1, 2, 3, 4, 5, 6, 7, 8, 9, 10 or more) 2'-deoxy, 2'-O-methyl, 2'-deoxy-2'-fluoro, 2'-O-trifluoromethyl, 2'-O-ethyl-trifluoromethoxy, 2'-O-difluoromethoxy-ethoxy, 4'-thio and/or one or more (e.g., about 1, 2, 3, 4, 5, 6, 7, 8, 9, 10 or more) universal base modified nucleotides, and optionally a terminal cap molecule at the 3'-end, the 5'-end, or both of the 3'- and 5'-ends of the antisense strand. In another embodiment, one or more, for example about 1, 2, 3, 4, 5, 6, 7, 8, 9, 10, or more, pyrimidine nucleotides of the sense and/or antisense siNA strand are chemically-modified with 2'-deoxy, 2'-O-methyl, 2'-O-trifluoromethyl, 2'-O-ethyl-trifluoromethoxy, 2'-O-difluoromethoxy-ethoxy, 4'-thio and/or 2'-deoxy-2'-fluoro nucleotides, with or without one or more, for example about 1, 2, 3, 4, 5, 6, 7, 8, 9, 10, or more, phosphorothioate internucleotide linkages and/or a terminal cap molecule at the 3'-end, the 5'-end, or both of the 3'- and 5'-ends, being present in the same or different strand.

In another embodiment, the invention features a siNA molecule, wherein the sense strand comprises about 1 to about 5, specifically about 1, 2, 3, 4, or 5 phosphorothioate internucleotide linkages, and/or one or more (e.g., about 1, 2, 3, 4, 5, or more) 2'-deoxy, 2'-O-methyl, 2'-deoxy-2'-fluoro, 2'-O-trifluoromethyl, 2'-O-ethyl-trifluoromethoxy, 2'-O-difluoromethoxy-ethoxy, 4'-thio and/or one or more (e.g., about 1, 2, 3, 4, 5, or more) universal base modified nucleotides, and optionally a terminal cap molecule at the 3-end, the 5'-end, or both of the 3'- and 5'-ends of the sense strand; and wherein the antisense strand comprises about 1 to about 5 or more, specifically about 1, 2, 3, 4, 5, or more phosphorothioate internucleotide linkages, and/or one or more (e.g., about 1, 2, 3, 4, 5, 6, 7, 8, 9, 10 or more) 2'-deoxy, 2'-O-methyl, 2'-deoxy-2'-fluoro, 2'-O-trifluoromethyl, 2'-O-ethyl-trifluoromethoxy, 2'-O-difluoromethoxy-ethoxy, 4'-thio and/or one or more (e.g., about 1, 2, 3, 4, 5, 6, 7, 8, 9, 10 or more) universal base modified nucleotides, and optionally a terminal cap molecule at the 3'-end, the 5'-end, or both of the 3'- and 5'-ends of the antisense strand. In another embodiment, one or more, for example about 1, 2, 3, 4, 5, 6, 7, 8, 9, 10, or more, pyrimidine nucleotides of the sense and/or antisense siNA strand are chemically-modified with 2'-deoxy, 2'-O-methyl, 2'-O-trifluoromethyl, 2'-O-ethyl-trifluoromethoxy, 2'-O-difluoromethoxy-ethoxy, 4'-thio and/or 2'-deoxy-2'-fluoro nucleotides, with or without about 1 to about 5 or more, for example about 1, 2, 3, 4, 5, or more phosphorothioate internucleotide linkages and/or a terminal cap molecule at the 3'-end, the 5'-end, or both of the 3'- and 5'-ends, being present in the same or different strand.

In one embodiment, the invention features a siNA molecule, wherein the sense strand comprises one or more, for example, about 1, 2, 3, 4, 5, 6, 7, 8, 9, 10, or more phosphorothioate internucleotide linkages, and/or about one or more (e.g., about 1, 2, 3, 4, 5, 6, 7, 8, 9, 10 or more) 2'-deoxy, 2'-O-methyl, 2'-deoxy-2'-fluoro, 2'-O-trifluoromethyl, 2'-O-ethyl-trifluoromethoxy, 2'-O-difluoromethoxy-ethoxy, 4'-thio and/or one or more (e.g., about 1, 2, 3, 4, 5, 6, 7, 8, 9, 10 or more) universal base modified nucleotides, and optionally a terminal cap molecule at the 3'-end, the 5'-end, or both of the 3'- and 5'-ends of the sense strand; and wherein the antisense strand comprises about 1 to about 10 or more, specifically about 1, 2, 3, 4, 5, 6, 7, 8, 9, 10 or more phosphorothioate internucleotide linkages, and/or one or more (e.g., about 1, 2, 3, 4, 5, 6, 7, 8, 9, 10 or more) 2'-deoxy, 2'-O-methyl, 2'-deoxy-2'-fluoro, 2'-O-trifluoromethyl, 2'-O-ethyl-trifluoromethoxy, 2'-O-difluoromethoxy-ethoxy, 4'-thio and/or one or more (e.g., about 1, 2, 3, 4, 5, 6, 7, 8, 9, 10 or more) universal base modified nucleotides, and optionally a terminal cap molecule at the 3'-end, the 5'-end, or both of the 3'- and 5'-ends of the antisense strand. In another embodiment, one or more, for example about 1, 2, 3, 4, 5, 6, 7, 8, 9, 10 or more pyrimidine nucleotides of the sense and/or antisense siNA strand are chemically-modified with 2'-deoxy, 2'-O-methyl, 2'-O-trifluoromethyl, 2'-O-ethyl-trifluoromethoxy, 2'-O-difluoromethoxy-ethoxy, 4'-thio and/or 2'-deoxy-2'-fluoro nucleotides, with or without one or more, for example, about 1, 2, 3, 4, 5, 6, 7, 8, 9, 10 or more phosphorothioate internucleotide linkages and/or a terminal cap molecule at the 3'-end, the 5'-end, or both of the 3' and 5'-ends, being present in the same or different strand.

In another embodiment, the invention features a siNA molecule, wherein the sense strand comprises about 1 to about 5 or more, specifically about 1, 2, 3, 4, 5 or more phosphorothioate internucleotide linkages, and/or one or more (e.g., about 1, 2, 3, 4, 5, 6, 7, 8, 9, 10 or more) 2'-deoxy, 2'-O-methyl, 2'-deoxy-2'-fluoro, 2'-O-trifluoromethyl, 2'-O-ethyl-trifluoromethoxy, 2'-O-difluoromethoxy-ethoxy, 4'-thio and/or one or more (e.g., about 1, 2, 3, 4, 5, 6, 7, 8, 9, 10 or more) universal base modified nucleotides, and optionally a terminal cap molecule at the 3'-end, the 5'-end, or both of the 3'- and 5'-ends of the sense strand; and wherein the antisense strand comprises about 1 to about 5 or more, specifically about 1, 2, 3, 4, 5 or more phosphorothioate internucleotide linkages, and/or one or more (e.g., about 1, 2, 3, 4, 5, 6, 7, 8, 9, 10 or more) 2'-deoxy, 2'-O-methyl, 2'-deoxy-2'-fluoro, 2'-O-trifluoromethyl, 2'-O-ethyl-trifluoromethoxy, 2'-O-difluoromethoxy-ethoxy, 4'-thio and/or one or more (e.g., about 1, 2, 3, 4, 5, 6, 7, 8, 9, 10 or more) universal base modified nucleotides, and optionally a terminal cap molecule at the 3'-end, the 5'-end, or both of the 3'- and 5'-ends of the antisense strand. In another embodiment, one or more, for example about 1, 2, 3, 4, 5, 6, 7, 8, 9, 10 or more pyrimidine nucleotides of the sense and/or antisense siNA strand are chemically-modified with 2'-deoxy, 2'-O-methyl, 2'-O-trifluoromethyl, 2'-O-ethyl-trifluoromethoxy, 2'-O-difluoromethoxy-ethoxy, 4'-thio and/or 2'-deoxy-2'-fluoro nucleotides, with or without about 1 to about 5, for example about 1, 2, 3, 4, 5 or more phosphorothioate internucleotide linkages and/or a terminal cap molecule at the 3'-end, the 5'-end, or both of the 3'- and 5'-ends, being present in the same or different strand.

In one embodiment, the invention features a chemically-modified short interfering nucleic acid (siNA) molecule having about 1 to about 5 or more (specifically about 1, 2, 3, 4, 5 or more) phosphorothioate internucleotide linkages in each strand of the siNA molecule.

In another embodiment, the invention features a siNA molecule comprising 2'-5' internucleotide linkages. The 2'-5' internucleotide linkage(s) can be at the 3'-end, the 5'-end, or both of the 3'- and 5'-ends of one or both strands. In addition, the 2'-5' internucleotide linkage(s) can be present at various other positions within one or both siNA sequence strands, for example, about 1, 2, 3, 4, 5, 6, 7, 8, 9, 10, or more including every internucleotide linkage of a pyrimidine nucleotide in one or both strands of the siNA molecule can comprise a 2'-5' internucleotide linkage, or about 1, 2, 3, 4, 5, 6, 7, 8, 9, 10, or more including every internucleotide linkage of a purine nucleotide in one or both strands of the siNA molecule can comprise a 2'-5' internucleotide linkage.

In another embodiment, a chemically-modified siNA molecule of the invention comprises a duplex having two strands, one or both of which can be chemically-modified, wherein each strand is independently about 15 to about 30 (e.g., about 15, 16, 17, 18, 19, 20, 21, 22, 23, 24, 25, 26, 27, 28, 29, or 30) nucleotides in length, wherein the duplex has about 15 to about 30 (e.g., about 15, 16, 17, 18, 19, 20, 21, 22, 23, 24, 25, 26, 27, 28, 29, or 30) base pairs, and wherein the chemical modification comprises a structure having any of Formulae I-VII. For example, an exemplary chemically-modified siNA molecule of the invention comprises a duplex having two strands, one or both of which can be chemically-modified with a chemical modification having any of Formulae I-VII or any combination thereof, wherein each strand consists of about 21 nucleotides, each having a 2-nucleotide 3'-terminal overhang, and wherein the duplex has about 19 base pairs. In another embodiment, a siNA molecule of the invention comprises a single stranded hairpin structure, wherein the siNA is about 36 to about 70 (e.g., about 36, 40, 45, 50, 55, 60, 65, or 70) nucleotides in length having about 15 to about 30 (e.g., about 15, 16, 17, 18, 19, 20, 21, 22, 23, 24, 25, 26, 27, 28, 29, or 30) base pairs, and wherein the siNA can include a chemical modification comprising a structure having any of Formulae I-VII or any combination thereof. For example, an exemplary chemically-modified siNA molecule of the invention comprises a linear oligonucleotide having about 42 to about 50 (e.g., about 42, 43, 44, 45, 46, 47, 48, 49, or 50) nucleotides that is chemically-modified with a chemical modification having any of Formulae I-VII or any combination thereof, wherein the linear oligonucleotide forms a hairpin structure having about 19 to about 21 (e.g., 19, 20, or 21) base pairs and a 2-nucleotide 3'-terminal overhang. In another embodiment, a linear hairpin siNA molecule of the invention contains a stem loop motif, wherein the loop portion of the siNA molecule is biodegradable. For example, a linear hairpin siNA molecule of the invention is designed such that degradation of the loop portion of the siNA molecule in vivo can generate a double-stranded siNA molecule with 3'-terminal overhangs, such as 3'-terminal nucleotide overhangs comprising about 2 nucleotides.

In another embodiment, a siNA molecule of the invention comprises a hairpin structure, wherein the siNA is about 25 to about 50 (e.g., about 25, 26, 27, 28, 29, 30, 31, 32, 33, 34, 35, 36, 37, 38, 39, 40, 41, 42, 43, 44, 45, 46, 47, 48, 49, or 50) nucleotides in length having about 3 to about 25 (e.g., about 3, 4, 5, 6, 7, 8, 9, 10, 11, 12, 13, 14, 15, 16, 17, 18, 19, 20, 21, 22, 23, 24, or 25) base pairs, and wherein the siNA can include one or more chemical modifications comprising a structure having any of Formulae I-VII or any combination thereof. For example, an exemplary chemically-modified siNA molecule of the invention comprises a linear oligonucleotide having about 25 to about 35 (e.g., about 25, 26, 27, 28, 29, 30, 31, 32, 33, 34, or 35) nucleotides that is chemically-modified with one or more chemical modifications having any of Formulae I-VII or any combination thereof, wherein the linear oligonucleotide forms a hairpin structure having about 3 to about 25 (e.g., about 3, 4, 5, 6, 7, 8, 9, 10, 11, 12, 13, 14, 15, 16, 17, 18, 19, 20, 21, 22, 23, 24, or 25) base pairs and a 5'-terminal phosphate group that can be chemically modified as described herein (for example a 5'-terminal phosphate group having Formula IV). In another embodiment, a linear hairpin siNA molecule of the invention contains a stem loop motif, wherein the loop portion of the siNA molecule is biodegradable. In one embodiment, a linear hairpin siNA molecule of the invention comprises a loop portion comprising a non-nucleotide linker.

In another embodiment, a siNA molecule of the invention comprises an asymmetric hairpin structure, wherein the siNA is about 25 to about 50 (e.g., about 25, 26, 27, 28, 29, 30, 31, 32, 33, 34, 35, 36, 37, 38, 39, 40, 41, 42, 43, 44, 45, 46, 47, 48, 49, or 50) nucleotides in length having about 3 to about 25 (e.g., about 3, 4, 5, 6, 7, 8, 9, 10, 11, 12, 13, 14, 15, 16, 17, 18, 19, 20, 21, 22, 23, 24, or 25) base pairs, and wherein the siNA can include one or more chemical modifications comprising a structure having any of Formulae I-VII or any combination thereof. For example, an exemplary chemically-modified siNA molecule of the invention comprises a linear oligonucleotide having about 25 to about 35 (e.g., about 25, 26, 27, 28, 29, 30, 31, 32, 33, 34, or 35) nucleotides that is chemically-modified with one or more chemical modifications having any of Formulae I-VII or any combination thereof, wherein the linear oligonucleotide forms an asymmetric hairpin structure having about 3 to about 25 (e.g., about 3, 4, 5, 6, 7, 8, 9, 10, 11, 12, 13, 14, 15, 16, 17, 18, 19, 20, 21, 22, 23, 24, or 25) base pairs and a 5'-terminal phosphate group that can be chemically modified as described herein (for example a 5'-terminal phosphate group having Formula IV). In one embodiment, an asymmetric hairpin siNA molecule of the invention contains a stem loop motif, wherein the loop portion of the siNA molecule is biodegradable. In another embodiment, an asymmetric hairpin siNA molecule of the invention comprises a loop portion comprising a non-nucleotide linker.

In another embodiment, a siNA molecule of the invention comprises an asymmetric double stranded structure having separate polynucleotide strands comprising sense and antisense regions, wherein the antisense region is about 15 to about 30 (e.g., about 15, 16, 17, 18, 19, 20, 21, 22, 23, 24, 25, 26, 27, 28, 29, or 30) nucleotides in length, wherein the sense region is about 3 to about 25 (e.g., about 3, 4, 5, 6, 7, 8, 9, 10, 11, 12, 13, 14, 15, 16, 17, 18, 19, 20, 21, 22, 23, 24, or 25) nucleotides in length, wherein the sense region and the antisense region have at least 3 complementary nucleotides, and wherein the siNA can include one or more chemical modifications comprising a structure having any of Formulae I-VII or any combination thereof. For example, an exemplary chemically-modified siNA molecule of the invention comprises an asymmetric double stranded structure having separate polynucleotide strands comprising sense and antisense regions, wherein the antisense region is about 18 to about 23 (e.g., about 18, 19, 20, 21, 22, or 23) nucleotides in length and wherein the sense region is about 3 to about 15 (e.g., about 3, 4, 5, 6, 7, 8, 9, 10, 11, 12, 13, 14, or 15) nucleotides in length, wherein the sense region the antisense region have at least 3 complementary nucleotides, and wherein the siNA can include one or more chemical modifications comprising a structure having any of Formulae I-VII or any combination thereof. In another embodiment, the asymmetric double stranded siNA molecule can also have a 5'-terminal phosphate group that can be chemically modified as described herein (for example a 5'-terminal phosphate group having Formula IV).

In another embodiment, a siNA molecule of the invention comprises a circular nucleic acid molecule, wherein the siNA is about 38 to about 70 (e.g., about 38, 40, 45, 50, 55, 60, 65, or 70) nucleotides in length having about 15 to about 30 (e.g., about 15, 16, 17, 18, 19, 20, 21, 22, 23, 24, 25, 26, 27, 28, 29, or 30) base pairs, and wherein the siNA can include a chemical modification, which comprises a structure having any of Formulae I-VII or any combination thereof. For example, an exemplary chemically-modified siNA molecule of the invention comprises a circular oligonucleotide having about 42 to about 50 (e.g., about 42, 43, 44, 45, 46, 47, 48, 49, or 50) nucleotides that is chemically-modified with a chemical modification having any of Formulae I-VII or any combination thereof, wherein the circular oligonucleotide forms a dumbbell shaped structure having about 19 base pairs and 2 loops.

In another embodiment, a circular siNA molecule of the invention contains two loop motifs, wherein one or both loop portions of the siNA molecule is biodegradable. For example, a circular siNA molecule of the invention is designed such that degradation of the loop portions of the siNA molecule in vivo can generate a double-stranded siNA molecule with 3'-terminal overhangs, such as 3'-terminal nucleotide overhangs comprising about 2 nucleotides.

In one embodiment, a siNA molecule of the invention comprises at least one (e.g., about 1, 2, 3, 4, 5, 6, 7, 8, 9, 10, or more) abasic moiety, for example a compound having Formula V:

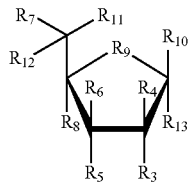

wherein each R3, R4, R5, R6, R7, R8, R10, R11, R12, and R13 is independently H, OH, alkyl, substituted alkyl, alkaryl or aralkyl, F, Cl, Br, CN, CF3, OCF3, OCH3, OCN, O-alkyl, S-alkyl, N-alkyl, O-alkenyl, S-alkenyl, N-alkenyl, SO-alkyl, alkyl-OSH, alkyl-OH, O-alkyl-OH, O-alkyl-SH, S-alkyl-OH, S-alkyl-SH, alkyl-S-alkyl, alkyl-O-alkyl, ONO2, NO2, N3, NH2, aminoalkyl, aminoacid, aminoacyl, ONH2, O-aminoalkyl, O-aminoacid, O-aminoacyl, heterocycloalkyl, heterocycloalkaryl, aminoalkylamino, polyalklylamino, substituted silyl, or a group having any of Formula I, II, III, IV, V, VI and/or VII, any of which can be included in the structure of the siNA molecule or serve as a point of attachment to the siNA molecule; R9 is O, S, CH2, S=O, CHF, or CF2. In one embodiment, R3 and/or R7 comprises a conjugate moiety and a linker (e.g., a nucleotide or non-nucleotide linker as described herein or otherwise known in the art). Non-limiting examples of conjugate moieties include ligands for cellular receptors, such as peptides derived from naturally occurring protein ligands; protein localization sequences, including cellular ZIP code sequences; antibodies; nucleic acid aptamers; vitamins and other co-factors, such as folate and N-acetylgalactosamine; polymers, such as polyethyleneglycol (PEG); phospholipids; cholesterol; steroids, and polyamines, such as PEI, spermine or spermidine.

In one embodiment, a siNA molecule of the invention comprises at least one (e.g., about 1, 2, 3, 4, 5, 6, 7, 8, 9, 10, or more) inverted abasic moiety, for example a compound having Formula VI:

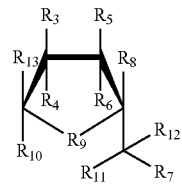

wherein each R3, R4, R5, R6, R7, R8, R10, R11, R12, and R13 is independently H, OH, alkyl, substituted alkyl, alkaryl or aralkyl, F, Cl, Br, CN, $CF_3$, $OCF_3$, $OCH_3$, OCN, O-alkyl, S-alkyl, N-alkyl, O-alkenyl, S-alkenyl, N-alkenyl, SO-alkyl, alkyl-OSH, alkyl-OH, O-alkyl-OH, O-alkyl-SH, S-alkyl-OH, S-alkyl-SH, alkyl-S-alkyl, alkyl-O-alkyl, ONO2, NO2, N3, NH2, aminoalkyl, aminoacid, aminoacyl, ONH2, O-aminoalkyl, O-aminoacid, O-aminoacyl, heterocycloalkyl, heterocycloalkaryl, aminoalkylamino, polyalklylamino, substituted silyl, or a group having any of Formula I, II, III, IV, V, VI and/or VII, any of which can be included in the structure of the siNA molecule or serve as a point of attachment to the siNA molecule; R9 is O, S, $CH_2$, S=O, CHF, or $CF_2$, and either R2, R3, R8 or R13 serve as points of attachment to the siNA molecule of the invention. In one embodiment, R3 and/or R7 comprises a conjugate moiety and a linker (e.g., a nucleotide or non-nucleotide linker as described herein or otherwise known in the art). Non-limiting examples of conjugate moieties include ligands for cellular receptors, such as peptides derived from naturally occurring protein ligands; protein localization sequences, including cellular ZIP code sequences; antibodies; nucleic acid aptamers; vitamins and other co-factors, such as folate and N-acetylgalactosamine; polymers, such as polyethyleneglycol (PEG); phospholipids; cholesterol; steroids, and polyamines, such as PEI, spermine or spermidine.

In another embodiment, a siNA molecule of the invention comprises at least one (e.g., about 1, 2, 3, 4, 5, 6, 7, 8, 9, 10, or more) substituted polyalkyl moieties, for example a compound having Formula VII:

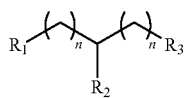

wherein each n is independently an integer from 1 to 12, each R1, R2 and R3 is independently H, OH, alkyl, substituted alkyl, alkaryl or aralkyl, F, Cl, Br, CN, $CF_3$, $OCF_3$, $OCH_3$, OCN, O-alkyl, S-alkyl, N-alkyl, O-alkenyl, S-alkenyl, N-alkenyl, SO-alkyl, alkyl-OSH, alkyl-OH, O-alkyl-OH, O-alkyl-SH, S-alkyl-OH, S-alkyl-SH, alkyl-S-alkyl, alkyl-O-alkyl, $ONO_2$, $NO_2$, $N_3$, $NH_2$, aminoalkyl, aminoacid, aminoacyl, $ONH_2$, O-aminoalkyl, O-aminoacid, O-aminoacyl, heterocycloalkyl, heterocycloalkaryl, aminoalkylamino, polyalklylamino, substituted silyl, or a group having any of Formula I, II, III, IV, V, VI and/or VII, any of which can be included in the structure of the siNA molecule or serve as a point of attachment to the siNA molecule. In one embodiment, R3 and/or R1 comprises a conjugate moiety and a linker (e.g., a nucleotide or non-nucleotide linker as described herein or otherwise known in the art). Non-limiting examples of conjugate moieties include ligands for cellular receptors, such as peptides derived from naturally occurring protein ligands; protein localization sequences, including cellular ZIP code sequences; antibodies; nucleic acid aptamers; vitamins and other co-factors, such as folate and N-acetylgalactosamine; polymers, such as polyethyleneglycol (PEG); phospholipids; cholesterol; steroids, and polyamines, such as PEI, spermine or spermidine.

By "ZIP code" sequences is meant, any peptide or protein sequence that is involved in cellular topogenic signaling mediated transport (see for example Ray et al., 2004, Science, 306(1501): 1505)

Each nucleotide within the double stranded siNA molecule can independently have a chemical modification comprising the structure of any of Formulae I-VIII. Thus, in one embodiment, one or more nucleotide positions of a siNA molecule of the invention comprises a chemical modification having structure of any of Formulae I-VII or any other modification herein. In one embodiment, each nucleotide position of a siNA molecule of the invention comprises a chemical modification having structure of any of Formulae I-VII or any other modification herein.

In one embodiment, one or more nucleotide positions of one or both strands of a double stranded siNA molecule of the invention comprises a chemical modification having structure of any of Formulae I-VII or any other modification herein. In one embodiment, each nucleotide position of one or both strands of a double stranded siNA molecule of the invention comprises a chemical modification having structure of any of Formulae I-VII or any other modification herein.

In another embodiment, the invention features a compound having Formula VII, wherein R1 and R2 are hydroxyl (OH) groups, n=1, and R3 comprises O and is the point of attachment to the 3'-end, the 5'-end, or both of the 3' and 5'-ends of one or both strands of a double-stranded siNA molecule of the invention or to a single-stranded siNA molecule of the invention. This modification is referred to herein as "glyceryl" (for example modification 6 in FIG. 10).

In another embodiment, a chemically modified nucleoside or non-nucleoside (e.g. a moiety having any of Formula V, VI or VII) of the invention is at the 3'-end, the 5'-end, or both of the 3' and 5'-ends of a siNA molecule of the invention. For example, chemically modified nucleoside or non-nucleoside (e.g., a moiety having Formula V, VI or VII) can be present at the 3'-end, the 5'-end, or both of the 3' and 5'-ends of the antisense strand, the sense strand, or both antisense and sense strands of the siNA molecule. In one embodiment, the chemically modified nucleoside or non-nucleoside (e.g., a moiety having Formula V, VI or VII) is present at the 5'-end and 3'-end of the sense strand and the 3'-end of the antisense strand of a double stranded siNA molecule of the invention. In one embodiment, the chemically modified nucleoside or non-nucleoside (e.g., a moiety having Formula V, VI or VII) is present at the terminal position of the 5'-end and 3'-end of the sense strand and the 3'-end of the antisense strand of a double stranded siNA molecule of the invention. In one embodiment, the chemically modified nucleoside or non-nucleoside (e.g., a moiety having Formula V, VI or VII) is present at the two terminal positions of the 5'-end and 3'-end of the sense strand and the 3'-end of the antisense strand of a double stranded siNA molecule of the invention. In one embodiment, the chemically modified nucleoside or non-nucleoside (e.g., a moiety having Formula V, VI or VII) is present at the penultimate position of the 5'-end and 3'-end of the sense strand and the 3'-end of the antisense strand of a double stranded siNA molecule of the invention. In addition, a moiety having Formula VII can be present at the 3'-end or the 5'-end of a hairpin siNA molecule as described herein.

In another embodiment, a siNA molecule of the invention comprises an abasic residue having Formula V or VI, wherein the abasic residue having Formula VI or VI is connected to the siNA construct in a 3'-3',3'-2',2'-3', or 5'-5' configuration, such as at the 3'-end, the 5'-end, or both of the 3' and 5'-ends of one or both siNA strands.

In one embodiment, a siNA molecule of the invention comprises one or more (e.g., about 1, 2, 3, 4, 5, 6, 7, 8, 9, 10, or more) locked nucleic acid (LNA) nucleotides, for example, at the 5'-end, the 3'-end, both of the 5' and 3'-ends, or any combination thereof, of the siNA molecule.

In one embodiment, a siNA molecule of the invention comprises one or more (e.g., about 1, 2, 3, 4, 5, 6, 7, 8, 9, 10, or more) 4'-thio nucleotides, for example, at the 5'-end, the 3'-end, both of the 5' and 3'-ends, or any combination thereof, of the siNA molecule.

In another embodiment, a siNA molecule of the invention comprises one or more (e.g., about 1, 2, 3, 4, 5, 6, 7, 8, 9, 10, or more) acyclic nucleotides, for example, at the 5'-end, the 3'-end, both of the 5' and 3'-ends, or any combination thereof, of the siNA molecule.

In one embodiment, a chemically-modified short interfering nucleic acid (siNA) molecule of the invention comprises a sense strand or sense region having one or more (e.g., 1, 2, 3, 4, 5, 6, 7, 8, 9, 10, 11, 12, 13, 14 15, 16, 17, 18, 19, 20, 21, 22, 23, 24, 25, 26, 27, 28, 29, 30 or more) 2'-O-alkyl (e.g. 2'-O-methyl), 2'-deoxy-2'-fluoro, 2'-deoxy, FANA, or abasic chemical modifications or any combination thereof.

In one embodiment, a chemically-modified short interfering nucleic acid (siNA) molecule of the invention comprises an antisense strand or antisense region having one or more (e.g., 1, 2, 3, 4, 5, 6, 7, 8, 9, 10, 11, 12, 13, 14 15, 16, 17, 18, 19, 20, 21, 22, 23, 24, 25, 26, 27, 28, 29, 30 or more) 2'-O-alkyl (e.g. 2'-O-methyl), 2'-deoxy-2'-fluoro, 2'-deoxy, FANA, or abasic chemical modifications or any combination thereof.

In one embodiment, a chemically-modified short interfering nucleic acid (siNA) molecule of the invention comprises a sense strand or sense region and an antisense strand or antisense region, each having one or more (e.g., 1, 2, 3, 4, 5, 6, 7, 8, 9, 10, 11, 12, 13, 14 15, 16, 17, 18, 19, 20, 21, 22, 23, 24, 25, 26, 27, 28, 29, 30 or more) 2'-O-alkyl (e.g. 2'-O-methyl), 2'-deoxy-2'-fluoro, 2'-deoxy, FANA, or abasic chemical modifications or any combination thereof.

In one embodiment, the invention features a chemically-modified short interfering nucleic acid (siNA) molecule of the invention comprising a sense region, wherein any (e.g., one or more or all) pyrimidine nucleotides present in the sense region are 2'-deoxy-2'-fluoro pyrimidine nucleotides (e.g., wherein all pyrimidine nucleotides are 2'-deoxy-2'-fluoro pyrimidine nucleotides or alternately a plurality (ie. more than one) of pyrimidine nucleotides are 2'-deoxy-2'-fluoro pyrimidine nucleotides).

In one embodiment, the invention features a chemically-modified short interfering nucleic acid (siNA) molecule of the invention comprising a sense region, wherein any (e.g., one or more or all) pyrimidine nucleotides present in the sense region are FANA pyrimidine nucleotides (e.g., wherein all pyrimidine nucleotides are FANA pyrimidine nucleotides or alternately a plurality (ie. more than one) of pyrimidine nucleotides are FANA pyrimidine nucleotides).

In one embodiment, the invention features a chemically-modified short interfering nucleic acid (siNA) molecule of the invention comprising an antisense region, wherein any (e.g., one or more or all) pyrimidine nucleotides present in the antisense region are 2'-deoxy-2'-fluoro pyrimidine nucleotides (e.g., wherein all pyrimidine nucleotides are 2'-deoxy-2'-fluoro pyrimidine nucleotides or alternately a plurality (ie. more than one) of pyrimidine nucleotides are 2'-deoxy-2'-fluoro pyrimidine nucleotides).

In one embodiment, the invention features a chemically-modified short interfering nucleic acid (siNA) molecule of the invention comprising a sense region and an antisense region, wherein any (e.g., one or more or all) pyrimidine nucleotides present in the sense region and the antisense region are 2'-deoxy-2'-fluoro pyrimidine nucleotides (e.g., wherein all pyrimidine nucleotides are 2'-deoxy-2'-fluoro pyrimidine nucleotides or alternately a plurality (ie. more than one) of pyrimidine nucleotides are 2'-deoxy-2'-fluoro pyrimidine nucleotides).

In one embodiment, the invention features a chemically-modified short interfering nucleic acid (siNA) molecule of the invention comprising a sense region, wherein any (e.g., one or more or all) purine nucleotides present in the sense region are 2'-deoxy purine nucleotides (e.g., wherein all purine nucleotides are 2'-deoxy purine nucleotides or alternately a plurality (ie. more than one) of purine nucleotides are 2'-deoxy purine nucleotides).

In one embodiment, the invention features a chemically-modified short interfering nucleic acid (siNA) molecule of the invention comprising an antisense region, wherein any (e.g., one or more or all) purine nucleotides present in the antisense region are 2'-O-methyl purine nucleotides (e.g., wherein all purine nucleotides are 2'-O-methyl purine nucleotides or alternately a plurality (ie. more than one) of pyrimidine nucleotides are 2'-O-methyl purine nucleotides).

In one embodiment, the invention features a chemically-modified short interfering nucleic acid (siNA) molecule of the invention comprising a sense region, wherein any (e.g., one or more or all) pyrimidine nucleotides present in the sense region are 2'-deoxy-2'-fluoro pyrimidine nucleotides (e.g., wherein all pyrimidine nucleotides are 2'-deoxy-2'-fluoro pyrimidine nucleotides or alternately a plurality (ie. more than one) of pyrimidine nucleotides are 2'-deoxy-2'-fluoro pyrimidine nucleotides), and wherein any (e.g., one or more or all) purine nucleotides present in the sense region are 2'-deoxy purine nucleotides (e.g., wherein all purine nucleotides are 2'-deoxy purine nucleotides or alternately a plurality (ie. more than one) of purine nucleotides are 2'-deoxy purine nucleotides).

In one embodiment, the invention features a chemically-modified short interfering nucleic acid (siNA) molecule of the invention comprising a sense region, wherein any (e.g., one or more or all) pyrimidine nucleotides present in the sense region are 2'-deoxy-2'-fluoro, 4'-thio, 2'-O-trifluoromethyl, 2'-O-ethyl-trifluoromethoxy, or 2'-O-difluoromethoxy-ethoxy pyrimidine nucleotides (e.g., wherein all pyrimidine nucleotides are 2'-deoxy-2'-fluoro, 4'-thio, 2'-O-trifluoromethyl, 2'-O-ethyl-trifluoromethoxy, or 2'-O-difluoromethoxy-ethoxy pyrimidine nucleotides or alternately a plurality (ie. more than one) of pyrimidine nucleotides are 2'-deoxy-2'-fluoro, 4'-thio, 2'-O-trifluoromethyl, 2'-O-ethyl-trifluoromethoxy, or 2'-O-difluoromethoxy-ethoxy pyrimidine-nucleotides), and wherein any (e.g., one or more or all) purine nucleotides present in the sense region are 2'-deoxy purine nucleotides (e.g., wherein all purine nucleotides are 2'-deoxy purine nucleotides or alternately a plurality (ie. more than one) of purine nucleotides are 2'-deoxy purine nucleotides), wherein any nucleotides comprising a 3'-terminal nucleotide overhang that are present in said sense region are 2'-deoxy nucleotides.

In one embodiment, the invention features a chemically-modified short interfering nucleic acid (siNA) molecule of the invention comprising a sense region, wherein any (e.g., one or more or all) pyrimidine nucleotides present in the sense region are 2'-deoxy-2'-fluoro, 4'-thio, 2'-O-trifluoromethyl, 2'-O-ethyl-trifluoromethoxy, or 2'-O-difluoromethoxy-ethoxy pyrimidine nucleotides (e.g., wherein all pyrimidine nucleotides are 2'-deoxy-2'-fluoro, 4'-thio, 2'-O-trifluoromethyl, 2'-O-ethyl-trifluoromethoxy, or 2'-O-difluoromethoxy-ethoxy pyrimidine nucleotides or alternately a plurality (ie. more than one) of pyrimidine nucleotides are 2'-deoxy-2'-fluoro, 4'-thio, 2'-O-trifluoromethyl, 2'-O-ethyl-trifluoromethoxy, or 2'-O-difluoromethoxy-ethoxy pyrimidine nucleotides), and wherein any (e.g., one or more or all) purine nucleotides present in the sense region are 2'-O-methyl purine nucleotides (e.g., wherein all purine nucleotides are 2'-O-methyl, 4'-thio, 2'-O-trifluoromethyl, 2'-O-ethyl-trifluoromethoxy, or 2'-O-difluoromethoxy-ethoxy purine nucleotides or alternately a plurality (ie. more than one) of purine nucleotides are 2'-O-methyl, 4'-thio, 2'-O-trifluoromethyl, 2'-O-ethyl-trifluoromethoxy, or 2'-O-difluoromethoxy-ethoxy purine nucleotides).

In one embodiment, the invention features a chemically-modified short interfering nucleic acid (siNA) molecule of the invention comprising a sense region, wherein any (e.g., one or more or all) pyrimidine nucleotides present in the sense region are 2'-deoxy-2'-fluoro, 4'-thio, 2'-O-trifluoromethyl, 2'-O-ethyl-trifluoromethoxy, or 2'-O-difluoromethoxy-ethoxy pyrimidine nucleotides (e.g., wherein all pyrimidine nucleotides are 2'-deoxy-2'-fluoro, 4'-thio, 2'-O-trifluorom-ethyl, 2'-O-ethyl-trifluoromethoxy, or 2'-O-difluoromethoxy-ethoxy pyrimidine nucleotides or alternately a plurality (ie. more than one) of pyrimidine nucleotides are 2'-deoxy-2'-fluoro, 4'-thio, 2'-O-trifluoromethyl, 2'-O-ethyl-trifluoromethoxy, or 2'-O-difluoromethoxy-ethoxy pyrimidine nucleotides), wherein any (e.g., one or more or all) purine nucleotides present in the sense region are 2'-O-methyl, 4'-thio, 2'-O-trifluoromethyl, 2'-O-ethyl-trifluoromethoxy, or 2'-O-difluoromethoxy-ethoxy purine nucleotides (e.g., wherein all purine nucleotides are 2'-O-methyl, 4'-thio, 2'-O-trifluoromethyl, 2'-O-ethyl-trifluoromethoxy, or 2'-O-difluoromethoxy-ethoxy purine nucleotides or alternately a plurality (ie. more than one) of purine nucleotides are 2'-O-methyl, 4'-thio, 2'-O-trifluoromethyl, 2'-O-ethyl-trifluoromethoxy, or 2'-O-difluoromethoxy-ethoxy purine nucleotides), and wherein any nucleotides comprising a 3'-terminal nucleotide overhang that are present in said sense region are 2'-deoxy nucleotides.

In one embodiment, the invention features a chemically-modified short interfering nucleic acid (siNA) molecule of the invention comprising an antisense region, wherein any (e.g., one or more or all) pyrimidine nucleotides present in the antisense region are 2'-deoxy-2'-fluoro, 4'-thio, 2'-O-trifluoromethyl, 2'-O-ethyl-trifluoromethoxy, or 2'-O-difluoromethoxy-ethoxy pyrimidine nucleotides (e.g., wherein all pyrimidine nucleotides are 2'-deoxy-2'-fluoro, 4'-thio, 2'-O-trifluoromethyl, 2'-O-ethyl-trifluoromethoxy, or 2'-O-difluoromethoxy-ethoxy pyrimidine nucleotides or alternately a plurality (ie. more than one) of pyrimidine nucleotides are 2'-deoxy-2'-fluoro, 4'-thio, 2'-O-trifluoromethyl, 2'-O-ethyl-trifluoromethoxy, or 2'-O-difluoromethoxy-ethoxy pyrimidine nucleotides), and wherein any (e.g., one or more or all) purine nucleotides present in the antisense region are 2'-O-methyl, 4'-thio, 2'-O-trifluoromethyl, 2'-O-ethyl-trifluoromethoxy, or 2'-O-difluoromethoxy-ethoxy purine nucleotides (e.g., wherein all purine nucleotides are 2'-O-methyl, 4'-thio, 2'-O-trifluoromethyl, 2'-O-ethyl-trifluoromethoxy, or 2'-O-difluoromethoxy-ethoxy purine nucleotides or alternately a plurality (ie. more than one) of purine nucleotides are 2'-O-methyl, 4'-thio, 2'-O-trifluoromethyl, 2'-O-ethyl-trifluoromethoxy, or 2'-O-difluoromethoxy-ethoxy purine nucleotides).

In one embodiment, the invention features a chemically-modified short interfering nucleic acid (siNA) molecule of the invention comprising an antisense region, wherein any (e.g., one or more or all) pyrimidine nucleotides present in the antisense region are 2'-deoxy-2'-fluoro, 4'-thio, 2'-O-trifluoromethyl, 2'-O-ethyl-trifluoromethoxy, or 2'-O-difluoromethoxy-ethoxy pyrimidine nucleotides (e.g., wherein all pyrimidine nucleotides are 2'-deoxy-2'-fluoro, 4'-thio, 2'-O-trifluoromethyl, 2'-O-ethyl-trifluoromethoxy, or 2'-O-difluoromethoxy-ethoxy pyrimidine nucleotides or alternately a plurality (ie. more than one) of pyrimidine nucleotides are 2'-deoxy-2'-fluoro, 4'-thio, 2'-O-trifluoromethyl, 2'-O-ethyl-trifluoromethoxy, or 2'-O-difluoromethoxy-ethoxy pyrimidine nucleotides), wherein any (e.g., one or more or all) purine nucleotides present in the antisense region are 2'-O-methyl, 4'-thio, 2'-O-trifluoromethyl, 2'-O-ethyl-trifluoromethoxy, or 2'-O-difluoromethoxy-ethoxy purine nucleotides (e.g., wherein all purine nucleotides are 2'-O-methyl, 4'-thio, 2'-O-trifluoromethyl, 2'-O-ethyl-trifluoromethoxy, or 2'-O-difluoromethoxy-ethoxy purine nucleotides or alternately a plurality (ie. more than one) of purine nucleotides are 2'-O-methyl, 4'-thio, 2'-O-trifluoromethyl, 2'-O-ethyl-trifluoromethoxy, or 2'-O-difluoromethoxy-ethoxy purine nucleotides), and wherein any nucleotides comprising a 3'-terminal nucleotide overhang that are present in said antisense region are 2'-deoxy nucleotides.

In one embodiment, the invention features a chemically-modified short interfering nucleic acid (siNA) molecule of the invention comprising an antisense region, wherein any (e.g., one or more or all) pyrimidine nucleotides present in the antisense region are 2'-deoxy-2'-fluoro, 4'-thio, 2'-O-trifluoromethyl, 2'-O-ethyl-trifluoromethoxy, or 2'-O-difluoromethoxy-ethoxy pyrimidine nucleotides (e.g., wherein all pyrimidine nucleotides are 2'-deoxy-2'-fluoro, 4'-thio, 2'-O-trifluoromethyl, 2'-O-ethyl-trifluoromethoxy, or 2'-O-difluoromethoxy-ethoxy pyrimidine nucleotides or alternately a plurality (ie. more than one) of pyrimidine nucleotides are 2'-deoxy-2'-fluoro, 4'-thio, 2'-O-trifluoromethyl, 2'-O-ethyl-trifluoromethoxy, or 2'-O-difluoromethoxy-ethoxy pyrimidine nucleotides), and wherein any (e.g., one or more or all) purine nucleotides present in the antisense region are 2'-deoxy purine nucleotides (e.g., wherein all purine nucleotides are 2'-deoxy purine nucleotides or alternately a plurality (ie. more than one) of purine nucleotides are 2'-deoxy purine nucleotides).

In one embodiment, the invention features a chemically-modified short interfering nucleic acid (siNA) molecule of the invention comprising an antisense region, wherein any (e.g., one or more or all) pyrimidine nucleotides present in the antisense region are 2'-deoxy-2'-fluoro, 4'-thio, 2'-O-trifluoromethyl, 2'-O-ethyl-trifluoromethoxy, or 2'-O-difluoromethoxy-ethoxy pyrimidine nucleotides (e.g., wherein all pyrimidine nucleotides are 2'-deoxy-2'-fluoro, 4'-thio, 2'-O-trifluoromethyl, 2'-O-ethyl-trifluoromethoxy, or 2'-O-difluoromethoxy-ethoxy pyrimidine nucleotides or alternately a plurality (ie. more than one) of pyrimidine nucleotides are 2'-deoxy-2'-fluoro, 4'-thio, 2'-O-trifluoromethyl, 2'-O-ethyl-trifluoromethoxy, or 2'-O-difluoromethoxy-ethoxy pyrimidine nucleotides), and wherein any (e.g., one or more or all) purine nucleotides present in the antisense region are 2'-O-methyl, 4'-thio, 2'-O-trifluoromethyl, 2'-O-ethyl-trifluoromethoxy, or 2'-O-difluoromethoxy-ethoxy purine nucleotides (e.g., wherein all purine nucleotides are 2'-O-methyl, 4'-thio, 2'-O-trifluoromethyl, 2'-O-ethyl-trifluoromethoxy, or 2'-O-difluoromethoxy-ethoxy purine nucleotides or alternately a plurality (ie. more than one) of purine nucleotides are 2'-O-methyl, 4'-thio, 2'-O-trifluoromethyl, 2'-O-ethyl-trifluoromethoxy, or 2'-O-difluoromethoxy-ethoxy purine nucleotides).

In one embodiment, the invention features a chemically-modified short interfering nucleic acid (siNA) molecule of the invention capable of mediating RNA interference (RNAi) inside a cell or reconstituted in vitro system comprising a sense region, wherein one or more pyrimidine nucleotides present in the sense region are 2'-deoxy-2'-fluoro, 4'-thio, 2'-O-trifluoromethyl, 2'-O-ethyl-trifluoromethoxy, or 2'-O-difluoromethoxy-ethoxy pyrimidine nucleotides (e.g., wherein all pyrimidine nucleotides are 2'-deoxy-2'-fluoro, 4'-thio, 2'-O-trifluoromethyl, 2'-O-ethyl-trifluoromethoxy, or 2'-O-difluoromethoxy-ethoxy pyrimidine nucleotides or alternately a plurality (ie. more than one) of pyrimidine nucleotides are 2'-deoxy-2'-fluoro, 4'-thio, 2'-O-trifluoromethyl, 2'-O-ethyl-trifluoromethoxy, or 2'-O-difluoromethoxy-ethoxy pyrimidine nucleotides), and one or more purine nucleotides present in the sense region are 2'-deoxy purine nucleotides (e.g., wherein all purine nucleotides are 2'-deoxy purine nucleotides or alternately a plurality (ie. more than one) of purine nucleotides are 2'-deoxy purine nucleotides), and an antisense region, wherein one or more pyrimidine nucleotides present in the antisense region are 2'-deoxy-2'-fluoro, 4'-thio, 2'-O-trifluoromethyl, 2'-O-ethyl-trifluoromethoxy, or 2'-O-difluoromethoxy-ethoxy pyrimidine nucleotides (e.g., wherein all pyrimidine nucleotides are 2'-deoxy-2'-fluoro, 4'-thio, 2'-O-trifluoromethyl, 2'-O-ethyl-trifluoromethoxy, or 2'-O-difluoromethoxy-ethoxy pyrimidine nucleotides or alternately a plurality (ie. more than one) of pyrimidine nucleotides are 2'-deoxy-2'-fluoro, 4'-thio, 2'-O-trifluoromethyl, 2'-O-ethyl-trifluoromethoxy, or 2'-O-difluoromethoxy-ethoxy pyrimidine nucleotides), and one or more purine nucleotides present in the antisense region are 2'-O-methyl, 4'-thio, 2'-O-trifluoromethyl, 2'-O-ethyl-trifluoromethoxy, or 2'-O-difluoromethoxy-ethoxy purine nucleotides (e.g., wherein all purine nucleotides are 2'-O-methyl, 4'-thio, 2'-O-trifluoromethyl, 2'-O-ethyl-trifluoromethoxy, or 2'-O-difluoromethoxy-ethoxy purine nucleotides or alternately a plurality (ie. more than one) of purine nucleotides are 2'-O-methyl, 4'-thio, 2'-O-trifluoromethyl, 2'-O-ethyl-trifluorometboxy, or 2'-O-difluoromethoxy-ethoxy purine nucleotides). The sense region and/or the antisense region can have a terminal cap modification, such as any modification described herein or shown in FIG. 10, that is optionally present at the 3'-end, the 5'-end, or both of the 3' and 5'-ends of the sense and/or antisense sequence. The sense and/or antisense region can optionally further comprise a 3'-terminal nucleotide overhang having about 1 to about 4 (e.g., about 1, 2, 3, or 4) 2'-deoxynucleotides. The overhang nucleotides can further comprise one or more (e.g., about 1, 2, 3, 4 or more) phosphorothioate, phosphonoacetate, and/or thiophosphonoacetate internucleotide linkages. Non-limiting examples of these chemically-modified siNAs are shown in FIGS. 4 and 5 and Table III herein. In any of these described embodiments, the purine nucleotides present in the sense region are alternatively 2'-O-methyl, 4'-thio, 2'-O-trifluoromethyl, 2'-O-ethyl-trifluoromethoxy, or 2'-O-difluoromethoxy-ethoxy purine nucleotides (e.g., wherein all purine nucleotides are 2'-O-methyl, 4'-thio, 2'-O-trifluoromethyl, 2'-O-ethyl-trifluoromethoxy, or 2'-O-difluoromethoxy-ethoxy purine nucleotides or alternately a plurality of purine nucleotides are 2'-O-methyl, 4'-thio, 2'-O-trifluoromethyl, 2'-O-ethyl-trifluoromethoxy, or 2'-O-difluoromethoxy-ethoxy purine nucleotides) and one or more purine nucleotides present in the antisense region are 2'-β-methyl, 4'-thio, 2'-O-trifluoromethyl, 2'-O-ethyl-trifluoromethoxy, or 2'-O-difluoromethoxy-ethoxy purine nucleotides (e.g., wherein all purine nucleotides are 2'-O-methyl, 4'-thio, 2'-O-trifluoromethyl, 2'-O-ethyl-trifluoromethoxy, or 2'-O-difluoromethoxy-ethoxy purine nucleotides or alternately a plurality (ie. more than one) of purine nucleotides are 2'-O-methyl, 4'-thio, 2'-O-trifluoromethyl, 2'-O-ethyl-trifluoromethoxy, or 2'-O-difluoromethoxy-ethoxy purine nucleotides). Also, in any of these embodiments, one or more purine nucleotides present in the sense region are alternatively purine ribonucleotides (e.g., wherein all purine nucleotides are purine ribonucleotides or alternately a plurality (ie. more than one) of purine nucleotides are purine ribonucleotides) and any purine nucleotides present in the antisense region are 2'-O-methyl, 4'-thio, 2'-O-trifluoromethyl, 2'-O-ethyl-trifluoromethoxy, or 2'-O-difluoromethoxy-ethoxy purine nucleotides (e.g., wherein all purine nucleotides are 2'-O-methyl, 4'-thio, 2'-O-trifluoromethyl, 2'-O-ethyl-trifluoromethoxy, or 2'-O-difluoromethoxy-ethoxy purine nucleotides or alternately a plurality (ie. more than one) of purine nucleotides are 2'-O-methyl, 4'-thio, 2'-O-trifluoromethyl, 2'-O-ethyl-trifluoromethoxy, or 2'-O-difluoromethoxy-ethoxy purine nucleotides). Additionally, in any of these embodiments, one or more purine nucleotides present in the sense region and/or present in the antisense region are alternatively selected from the group consisting of 2'-deoxy nucleotides, locked nucleic acid (LNA) nucleotides, 2'-methoxyethyl nucleotides, 4'-thionucleotides, 2'-O-trifluoromethyl nucleotides, 2'-O-ethyl-trifluoromethoxy nucleotides, 2'-O-difluoromethoxy-ethoxy nucleotides and 2'-O-methyl nucleotides (e.g., wherein all purine nucleotides are selected from the group consisting of 2'-deoxy nucleotides, locked nucleic acid (LNA) nucleotides, 2'-methoxyethyl nucleotides, 4'-thionucleotides, 2'-O-trifluoromethyl nucleotides, 2'-O-ethyl-trifluoromethoxy nucleotides, 2'-O-difluoromethoxy-ethoxy nucleotides and 2'-O-methyl nucleotides or alternately a plurality (ie. more than one) of purine nucleotides are selected from the group consisting of 2'-deoxy nucleotides, locked nucleic acid (LNA) nucleotides, 2'-methoxyethyl nucleotides, 4'-thionucleotides, 2'-O-trifluoromethyl nucleotides, 2'-O-ethyl-trifluoromethoxy nucleotides, 2'-O-difluoromethoxy-ethoxy nucleotides and 2'-O-methyl nucleotides).

In another embodiment, any modified nucleotides present in the siNA molecules of the invention, preferably in the antisense strand of the siNA molecules of the invention, but also optionally in the sense and/or both antisense and sense strands, comprise modified nucleotides having properties or characteristics similar to naturally occurring ribonucleotides. For example, the invention features siNA molecules including modified nucleotides having a Northern conformation (e.g., Northern pseudorotation cycle, see for example Saenger, *Principles of Nucleic Acid Structure*, Springer-Verlag ed., 1984) otherwise known as a "ribo-like" or "A-form helix" configuration. As such, chemically modified nucleotides present in the siNA molecules of the invention, preferably in the antisense strand of the siNA molecules of the invention, but also optionally in the sense and/or both antisense and sense strands, are resistant to nuclease degradation while at the same time maintaining the capacity to mediate RNAi. Non-limiting examples of nucleotides having a northern configuration include locked nucleic acid (LNA) nucleotides (e.g., 2'-O, 4'-C-methylene-(D-ribofuranosyl) nucleotides); 2'-methoxyethoxy (MOE) nucleotides; 2'-methyl-thio-ethyl, 2'-deoxy-2'-fluoro nucleotides, 2'-deoxy-2'-chloro nucleotides, 2'-azido nucleotides, 2'-O-trifluoromethyl nucleotides, 2'-O-ethyl-trifluoromethoxy nucleotides, 2'-O-difluoromethoxy-ethoxy nucleotides, 4'-thio nucleotides and 2'-O-methyl nucleotides.

In one embodiment, the sense strand of a double stranded siNA molecule of the invention comprises a terminal cap moiety, (see for example FIG. 10) such as an inverted deoxyabasic moiety, at the 3'-end, 5'-end, or both 3' and 5'-ends of the sense strand.

In one embodiment, the invention features a chemically-modified short interfering nucleic acid molecule (siNA) capable of mediating RNA interference (RNAi) inside a cell or reconstituted in vitro system, wherein the chemical modification comprises a conjugate covalently attached to the chemically-modified siNA molecule. Non-limiting examples of conjugates contemplated by the invention include conjugates and ligands described in Vargeese et al., U.S. Ser. No. 10/427,160, filed Apr. 30, 2003, incorporated by reference herein in its entirety, including the drawings. In another embodiment, the conjugate is covalently attached to the chemically-modified siNA molecule via a biodegradable linker. In one embodiment, the conjugate molecule is attached at the 3'-end of either the sense strand, the antisense strand, or both strands of the chemically-modified siNA molecule. In another embodiment, the conjugate molecule is attached at the 5'-end of either the sense strand, the antisense strand, or both strands of the chemically-modified siNA molecule. In yet another embodiment, the conjugate molecule is attached both the 3'-end and 5'-end of either the sense strand, the antisense strand, or both strands of the chemically-modified siNA molecule, or any combination thereof. In one embodiment, a conjugate molecule of the invention comprises a molecule that facilitates delivery of a chemically-modified siNA molecule into a biological system, such as a cell. In another embodiment, the conjugate molecule attached to the chemically-modified siNA molecule is a ligand for a cellular receptor, such as peptides derived from naturally occurring protein ligands; protein localization sequences, including cellular ZIP code sequences; antibodies; nucleic acid aptamers; vitamins and other co-factors, such as folate and N-acetylgalactosamine; polymers, such as polyethyleneglycol (PEG); phospholipids; cholesterol; steroids, and polyamines, such as PEI, spermine or spermidine. Examples of specific conjugate molecules contemplated by the instant invention that can be attached to chemically-modified siNA molecules are described in Vargeese et al., U.S. Ser. No. 10/201,394, filed Jul. 22, 2002 incorporated by reference herein. The type of conjugates used and the extent of conjugation of siNA molecules of the invention can be evaluated for improved pharmacokinetic profiles, bioavailability, and/or stability of siNA constructs while at the same time maintaining the ability of the siNA to mediate RNAi activity. As such, one skilled in the art can screen siNA constructs that are modified with various conjugates to determine whether the siNA conjugate complex possesses improved properties while maintaining the ability to mediate RNAi, for example in animal models as are generally known in the art.

In one embodiment, the invention features a short interfering nucleic acid (siNA) molecule of the invention, wherein the siNA further comprises a nucleotide, non-nucleotide, or mixed nucleotide/non-nucleotide linker that joins the sense region of the siNA to the antisense region of the siNA. In one embodiment, a nucleotide, non-nucleotide, or mixed nucleotide/non-nucleotide linker is used, for example, to attach a conjugate moiety to the siNA. In one embodiment, a nucleotide linker of the invention can be a linker of $\geq 2$ nucleotides in length, for example about 3, 4, 5, 6, 7, 8, 9, or 10 nucleotides in length. In another embodiment, the nucleotide linker can be a nucleic acid aptamer. By "aptamer" or "nucleic acid aptamer" as used herein is meant a nucleic acid molecule that binds specifically to a HCV target molecule wherein the nucleic acid molecule has sequence that comprises a sequence recognized by the HCV target molecule in its natural setting. Alternately, an aptamer can be a nucleic acid molecule that binds to a HCV target molecule where the HCV target molecule does not naturally bind to a nucleic acid. The HCV target molecule can be any molecule of interest. For example, the aptamer can be used to bind to a ligand-binding domain of a protein, thereby preventing interaction of the naturally occurring ligand with the protein. This is a non-limiting example and those in the art will recognize that other embodiments can be readily generated using techniques generally known in the art. (See, for example, Gold et al., 1995, *Annu. Rev. Biochem.*, 64, 763; Brody and Gold, 2000, *J. Biotechnol.*, 74, 5; Sun, 2000, *Curr. Opin. Mol. Ther.*, 2, 100; Kusser, 2000, *J. Biotechnol.*, 74, 27; Hermann and Patel, 2000, *Science*, 287, 820; and Jayasena, 1999, *Clinical Chemistry*, 45, 1628.)

In yet another embodiment, a non-nucleotide linker of the invention comprises abasic nucleotide, polyether, polyamine, polyamide, peptide, carbohydrate, lipid, polyhydrocarbon, or other polymeric compounds (e.g. polyethylene glycols such as those having between 2 and 100 ethylene glycol units). Specific examples include those described by Seela and Kaiser, *Nucleic Acids Res.* 1990, 18:6353 and *Nucleic Acids Res.* 1987, 15:3113; Cload and Schepartz, *J. Am. Chem. Soc.* 1991, 113:6324; Richardson and Schepartz, *J. Am. Chem. Soc.* 1991, 113:5109; Ma et al., *Nucleic Acids Res.* 1993, 21:2585 and *Biochemistry* 1993, 32:1751; Durand et al., *Nucleic Acids Res.* 1990, 18:6353; McCurdy et al., *Nucleosides & Nucleotides* 1991, 10:287; Jschke et al., *Tetrahedron Lett.* 1993, 34:301; Ono et al., *Biochemistry* 1991, 30:9914; Arnold et al., International Publication No. WO 89/02439; Usman et al., International Publication No. WO 95/06731; Dudycz et al., International Publication No. WO 95/11910 and Ferentz and Verdine, *J. Am. Chem. Soc.* 1991, 113:4000, all hereby incorporated by reference herein. A "non-nucleotide" further means any group or compound that can be incorporated into a nucleic acid chain in the place of one or more nucleotide units, including either sugar and/or phosphate substitutions, and allows the siNA molecule to retain RNAi activity or RNAi inhibitory to retain its inhibition activity. The group or compound can be abasic in that it does not contain a commonly recognized nucleotide base, such as adenosine, guanine, cytosine, uracil or thymine, for example at the C1 position of the sugar.

In one embodiment, the invention features a short interfering nucleic acid (siNA) molecule capable of mediating RNA interference (RNAi) inside a cell or reconstituted in vitro system, wherein one or both strands of the siNA molecule that are assembled from two separate oligonucleotides do not comprise any ribonucleotides (e.g., one or both strands of the siNA molecule are 100% chemically modified). For example, a siNA molecule can be assembled from a single oligonucleotide where the sense and antisense regions of the siNA comprise separate oligonucleotides that do not have any ribonucleotides (e.g., nucleotides having a 2'-OH group) present in the oligonucleotides. In another example, a siNA molecule can be assembled from a single oligonucleotide where the sense and antisense regions of the siNA are linked or circularized by a nucleotide or non-nucleotide linker as described herein, wherein the oligonucleotide does not have any ribonucleotides (e.g., nucleotides having a 2'-OH group) present in the oligonucleotide. Applicant has surprisingly found that the presence of ribonucleotides (e.g., nucleotides having a 2'-hydroxyl group) within the siNA molecule is not required or essential to support RNAi activity. As such, in one embodiment, all positions within the siNA can include chemically modified nucleotides and/or non-nucleotides such as nucleotides and or non-nucleotides having Formula I, II, III, IV, V, VI, or VII or any combination thereof to the extent that the ability of the siNA molecule to support RNAi activity in a cell is maintained.

In one embodiment, a siNA molecule of the invention is a single stranded siNA molecule that mediates RNAi activity in a cell or reconstituted in vitro system comprising a single stranded polynucleotide having complementarity to a HCV target nucleic acid sequence. In another embodiment, the single stranded siNA molecule of the invention comprises a 5'-terminal phosphate group. In another embodiment, the single stranded siNA molecule of the invention comprises a 5'-terminal phosphate group and a 3'-terminal phosphate group (e.g., a 2',3'-cyclic phosphate). In another embodiment, the single stranded siNA molecule of the invention comprises about 15 to about 30 (e.g., about 15, 16, 17, 18, 19, 20, 21, 22, 23, 24, 25, 26, 27, 28, 29, or 30) nucleotides. In yet another embodiment, the single stranded siNA molecule of the invention comprises one or more chemically modified nucleotides or non-nucleotides described herein. For example, all the positions within the siNA molecule can include chemically-modified nucleotides such as nucleotides having any of Formulae I-VII, or any combination thereof to the extent that the ability of the siNA molecule to support RNAi activity in a cell is maintained.

In one embodiment, a siNA molecule of the invention is a single stranded siNA molecule that mediates RNAi activity or that alternately modulates RNAi activity in a cell or reconstituted in vitro system comprising a single stranded polynucleotide having complementarity to a HCV target nucleic acid sequence, wherein one or more pyrimidine nucleotides present in the siNA are 2'-deoxy-2'-fluoro, 4'-thio, 2'-O-trifluoromethyl, 2'-O-ethyl-trifluoromethoxy, or 2'-O-difluoromethoxy-ethoxy pyrimidine nucleotides (e.g., wherein all pyrimidine nucleotides are 2'-deoxy-2'-fluoro, 4'-thio, 2'-O-trifluoromethyl, 2'-O-ethyl-trifluoromethoxy, or 2'-O-difluoromethoxy-ethoxy pyrimidine nucleotides or alternately a plurality of pyrimidine nucleotides are 2'-deoxy-2'-fluoro, 4'-thio, 2'-O-trifluoromethyl, 2'-O-ethyl-trifluoromethoxy, or 2'-O-difluoromethoxy-ethoxy pyrimidine nucleotides), and wherein any purine nucleotides present in the antisense region are 2'-O-methyl, 4'-thio, 2'-O-trifluoromethyl, 2'-O-ethyl-trifluoromethoxy, or 2'-O-difluoromethoxy-ethoxy purine nucleotides (e.g., wherein all purine nucleotides are 2'-O-methyl, 4'-thio, 2'-O-trifluoromethyl, 2'-O-ethyl-trifluoromethoxy, or 2'-O-difluoromethoxy-ethoxy purine nucleotides or alternately a plurality of purine nucleotides are 2'-O-methyl, 4'-thio, 2'-O-trifluoromethyl, 2'-O-ethyl-trifluoromethoxy, or 2'-O-difluoromethoxy-ethoxy purine nucleotides), and a terminal cap modification, such as any modification described herein or shown in FIG. 10, that is optionally present at the 3'-end, the 5'-end, or both of the 3' and 5'-ends of the antisense sequence. The siNA optionally further comprises about 1 to about 4 or more (e.g., about 1, 2, 3, 4 or more) terminal 2'-deoxynucleotides at the 3'-end of the siNA molecule, wherein the terminal nucleotides can further comprise one or more (e.g., 1, 2, 3, 4 or more) phosphorothioate, phosphonoacetate, and/or thiophosphonoacetate internucleotide linkages, and wherein the siNA optionally further comprises a terminal phosphate group, such as a 5'-terminal phosphate group. In any of these embodiments, any purine nucleotides present in the antisense region are alternatively 2'-deoxy purine nucleotides (e.g., wherein all purine nucleotides are 2'-deoxy purine nucleotides or alternately a plurality of purine nucleotides are 2'-deoxy purine nucleotides). Also, in any of these embodiments, any purine nucleotides present in the siNA (i.e., purine nucleotides present in the sense and/or antisense region) can alternatively be locked nucleic acid (LNA) nucleotides (e.g., wherein all purine nucleotides are LNA nucleotides or alternately a plurality of purine nucleotides are LNA nucleotides). Also, in any of these embodiments, any purine nucleotides present in the siNA are alternatively 2'-methoxyethyl purine nucleotides (e.g., wherein all purine nucleotides are 2'-methoxyethyl purine nucleotides or alternately a plurality of purine nucleotides are 2'-methoxyethyl purine nucleotides). In another embodiment, any modified nucleotides present in the single stranded siNA molecules of the invention comprise modified nucleotides having properties or characteristics similar to naturally occurring ribonucleotides. For example, the invention features siNA molecules including modified nucleotides having a Northern conformation (e.g., Northern pseudorotation cycle, see for example Saenger, *Principles of Nucleic Acid Structure*, Springer-Verlag ed., 1984). As such, chemically modified nucleotides present in the single stranded siNA molecules of the invention are preferably resistant to nuclease degradation while at the same time maintaining the capacity to mediate RNAi.

In one embodiment, a chemically-modified short interfering nucleic acid (siNA) molecule of the invention comprises a sense strand or sense region having two or more (e.g., 2, 3, 4, 5, 6, 7, 8, 9, 10, 11, 12, 13, 14 15, 16, 17, 18, 19, 20, 21, 22, 23, 24, 25, 26, 27, 28, 29, 30 or more) 2'-O-alkyl (e.g. 2'-O-methyl) modifications or any combination thereof. In another embodiment, the 2'-O-alkyl modification is at alternating position in the sense strand or sense region of the siNA, such as position 1, 3, 5, 7, 9, 11, 13, 15, 17, 19, 21 etc. or position 2, 4, 6, 8, 10, 12, 14, 16, 18, 20 etc.

In one embodiment, a chemically-modified short interfering nucleic acid (siNA) molecule of the invention comprises an antisense strand or antisense region having two or more (e.g., 2, 3, 4, 5, 6, 7, 8, 9, 10, 11, 12, 13, 14 15, 16, 17, 18, 19, 20, 21, 22, 23, 24, 25, 26, 27, 28, 29, 30 or more) 2'-O-alkyl (e.g. 2'-O-methyl) modifications or any combination thereof. In another embodiment, the 2'-O-alkyl modification is at alternating position in the antisense strand or antisense region of the siNA, such as position 1, 3, 5, 7, 9, 11, 13, 15, 17, 19, 21 etc. or position 2, 4, 6, 8, 10, 12, 14, 16, 18, 20 etc.

In one embodiment, a chemically-modified short interfering nucleic acid (siNA) molecule of the invention comprises a sense strand or sense region and an antisense strand or antisense region, each having two or more (e.g., 2, 3, 4, 5, 6, 7, 8, 9, 10, 11, 12, 13, 14 15, 16, 17, 18, 19, 20, 21, 22, 23, 24, 25, 26, 27, 28, 29, 30 or more) 2'-O-alkyl (e.g. 2'-O-methyl), 2'-deoxy-2'-fluoro, 2'-deoxy, or abasic chemical modifications or any combination thereof. In another embodiment, the 2'-O-alkyl modification is at alternating position in the sense strand or sense region of the siNA, such as position 1, 3, 5, 7, 9, 11, 13, 15, 17, 19, 21 etc. or position 2, 4, 6, 8, 10, 12, 14, 16, 18, 20 etc. In another embodiment, the 2'-O-alkyl modification is at alternating position in the antisense strand or antisense region of the siNA, such as position 1, 3, 5, 7, 9, 11, 13, 15, 17, 19, 21 etc. or position 2, 4, 6, 8, 10, 12, 14, 16, 18, 20 etc.

In one embodiment, a siNA molecule of the invention comprises chemically modified nucleotides or non-nucleotides (e.g., having any of Formulae I-VII, such as 2'-deoxy, 2'-deoxy-2'-fluoro, 4'-thio, 2'-O-trifluoromethyl, 2'-O-ethyl-trifluoromethoxy, 2'-O-difluoromethoxy-ethoxy or 2'-O-methyl nucleotides) at alternating positions within one or more strands or regions of the siNA molecule. For example, such chemical modifications can be introduced at every other position of a RNA based siNA molecule, starting at either the first or second nucleotide from the 3'-end or 5'-end of the siNA. In a non-limiting example, a double stranded siNA molecule of the invention in which each strand of the siNA is 21 nucleotides in length is featured wherein positions 1, 3, 5, 7, 9, 11, 13, 15, 17, 19 and 21 of each strand are chemically modified (e.g., with compounds having any of Formulae I-VII, such as such as 2'-deoxy, 2'-deoxy-2'-fluoro, 4'-thio, 2'-O-trifluoromethyl, 2'-O-ethyl-trifluoromethoxy, 2'-O-difluoromethoxy-ethoxy or 2'-O-methyl nucleotides). In another non-limiting example, a double stranded siNA molecule of the invention in which each strand of the siNA is 21 nucleotides in length is featured wherein positions 2, 4, 6, 8, 10, 12, 14, 16, 18, and 20 of each strand are chemically modified (e.g., with compounds having any of Formulae I-VII, such as such as 2'-deoxy, 2'-deoxy-2'-fluoro, 4'-thio, 2'-O-trifluoromethyl, 2'-O-ethyl-trifluoromethoxy, 2'-O-difluoromethoxy-ethoxy or 2'-O-methyl nucleotides). In one embodiment, one strand of the double stranded siNA molecule comprises chemical modifications at positions 2, 4, 6, 8, 10, 12, 14, 16, 18, and 20 and chemical modifications at positions 1, 3, 5, 7, 9, 11, 13, 15, 17, 19 and 21. Such siNA molecules can further comprise terminal cap moieties and/or backbone modifications as described herein.

In one embodiment, a siNA molecule of the invention comprises the following features: if purine nucleotides are present at the 5'-end (e.g., at any of terminal nucleotide positions 1, 2, 3, 4, 5, or 6 from the 5'-end) of the antisense strand or antisense region (otherwise referred to as the guide sequence or guide strand) of the siNA molecule then such purine nucleosides are ribonucleotides. In another embodiment, the purine ribonucleotides, when present, are base paired to nucleotides of the sense strand or sense region (otherwise referred to as the passenger strand) of the siNA molecule. Such purine ribonucleotides can be present in a siNA stabilization motif that otherwise comprises modified nucleotides.

In one embodiment, a siNA molecule of the invention comprises the following features: if pyrimidine nucleotides are present at the 5'-end (e.g., at any of terminal nucleotide positions 1, 2, 3, 4, 5, or 6 from the 5'-end) of the antisense strand or antisense region (otherwise referred to as the guide sequence or guide strand) of the siNA molecule then such pyrimidine nucleosides are ribonucleotides. In another embodiment, the pyrimidine ribonucleotides, when present, are base paired to nucleotides of the sense strand or sense region (otherwise referred to as the passenger strand) of the siNA molecule. Such pyrimidine ribonucleotides can be present in a siNA stabilization motif that otherwise comprises modified nucleotides.

In one embodiment, a siNA molecule of the invention comprises the following features: if pyrimidine nucleotides are present at the 5'-end (e.g., at any of terminal nucleotide positions 1, 2, 3, 4, 5, or 6 from the 5'-end) of the antisense strand or antisense region (otherwise referred to as the guide sequence or guide strand) of the siNA molecule then such pyrimidine nucleosides are modified nucleotides. In another embodiment, the modified pyrimidine nucleotides, when present, are base paired to nucleotides of the sense strand or sense region (otherwise referred to as the passenger strand) of the siNA molecule. Non-limiting examples of modified pyrimidine nucleotides include those having any of Formulae I-VII, such as such as 2'-deoxy, 2'-deoxy-2'-fluoro, 4'-thio, 2'-O-trifluoromethyl, 2'-O-ethyl-trifluoromethoxy, 2'-O-difluoromethoxy-ethoxy or 2'-O-methyl nucleotides.

In one embodiment, the invention features a double stranded nucleic acid molecule having structure SI:

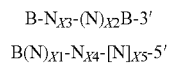

SI

B-N$_{X3}$-(N)$_{X2}$B-3'

B(N)$_{X1}$-N$_{X4}$-[N]$_{X5}$-5' wherein each N is independently a nucleotide which can be unmodified or chemically modified; each B is a terminal cap moiety that can be present or absent; (N) represents non-base paired or overhanging nucleotides which can be unmodified or chemically modified; [N] represents nucleotide positions wherein any purine nucleotides when present are ribonucleotides; X1 and X2 are independently integers from about 0 to about 4; X3 is an integer from about 9 to about 30; X4 is an integer from about 11 to about 30, provided that the sum of X4 and X5 is between 17-36; X5 is an integer from about 1 to about 6; NX3 is complementary to NX4 and NX5, and (a) any pyrimidine nucleotides present in the antisense strand (lower strand) are 2'-deoxy-2'-fluoro nucleotides; any purine nucleotides present in the antisense strand (lower strand) other than the purines nucleotides in the [N] nucleotide positions, are independently 2'-O-methyl nucleotides, 2'-deoxyribonucleotides or a combination of 2'-deoxyribonucleotides and 2'-O-methyl nucleotides;

(b) any pyrimidine nucleotides present in the sense strand (upper strand) are 2'-deoxy-2'-fluoro nucleotides; any purine nucleotides present in the sense strand (upper strand) are independently 2'-deoxyribonucleotides, 2'-O-methyl nucleotides or a combination of 2'-deoxyribonucleotides and 2'-O-methyl nucleotides; and (c) any (N) nucleotides are optionally 2'-O-methyl, 2'-deoxy-2'-fluoro, or deoxyribonucleotides.

In one embodiment, the invention features a double stranded nucleic acid molecule having structure SII:

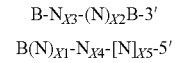

SII

B-N$_{X3}$-(N)$_{X2}$B-3'

B(N)$_{X1}$-N$_{X4}$-[N]$_{X5}$-5' wherein each N is independently a nucleotide which can be unmodified or chemically modified; each B is a terminal cap moiety that can be present or absent; (N) represents non-base paired or overhanging nucleotides which can be unmodified or chemically modified; [N] represents nucleotide positions wherein any purine nucleotides when present are ribonucleotides; X1 and X2 are independently integers from about 0 to about 4; X3 is an integer from about 9 to about 30; X4 is an integer from about 11 to about 30, provided that the sum of X4 and X5 is between 17-36; X5 is an integer from about 1 to about 6; NX3 is complementary to NX4 and NX5, and (a) any pyridmidine nucleotides present in the antisense strand (lower strand) are 2'-deoxy-2'-fluoro nucleotides; any purine nucleotides present in the antisense strand (lower strand) other than the purines nucleotides in the [N] nucleotide positions, are 2'-O-methyl nucleotides;

(b) any pyrimidine nucleotides present in the sense strand (upper strand) are ribonucleotides; any purine nucleotides present in the sense strand (upper strand) are ribonucleotides; and (c) any (N) nucleotides are optionally 2'-O-methyl, 2'-deoxy-2'-fluoro, or deoxyribonucleotides.

In one embodiment, the invention features a double stranded nucleic acid molecule having structure SIII:

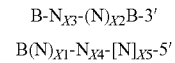

SIII

B-N$_{X3}$-(N)$_{X2}$B-3'

B(N)$_{X1}$-N$_{X4}$-[N]$_{X5}$-5' wherein each N is independently a nucleotide which can be unmodified or chemically modified; each B is a terminal cap moiety that can be present or absent; (N) represents non-base paired or overhanging nucleotides which can be unmodified or chemically modified; [N] represents nucleotide positions wherein any purine nucleotides when present are ribonucleotides; X1 and X2 are independently integers from about 0 to about 4; X3 is an integer from about 9 to about 30; X4 is an integer from about 11 to about 30, provided that the sum of X4 and X5 is between 17-36; X5 is an integer from about 1 to about 6; NX3 is complementary to NX4 and NX5, and (a) any pyridmidine nucleotides present in the antisense strand (lower strand) are 2'-deoxy-2'-fluoro nucleotides; any purine nucleotides present in the antisense strand (lower strand) other than the purines nucleotides in the [N] nucleotide positions, are 2'-O-methyl nucleotides;

(b) any pyrimidine nucleotides present in the sense strand (upper strand) are 2'-deoxy-2'-fluoro nucleotides; any purine nucleotides present in the sense strand (upper strand) are ribonucleotides; and (c) any (N) nucleotides are optionally 2'-O-methyl, 2'-deoxy-2'-fluoro, or deoxyribonucleotides.

In one embodiment, the invention features a double stranded nucleic acid molecule having structure SIV:
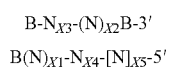 SIV
wherein each N is independently a nucleot wherein each N is independently a nucleotide which can be unmodified or chemically modified; each B is a terminal cap moiety that can be present or absent; (N) represents non-base paired or overhanging nucleotides which can be unmodified or chemically modified; [N] represents nucleotide positions comprising sequence that renders the 5'-end of the antisense strand (lower strand) less thermally stable than the 5'-end of the sense strand (upper strand); [N] represents nucleotide positions that are ribonucleotides; X1 and X2 are independently integers from about 0 to about 4; X3 is an integer from about 9 to about 15; X4 is an integer from about 11 to about 30, provided that the sum of X4 and X5 is between 17-36; X5 is an integer from about 1 to about 6; X6 is an integer from about 1 to about 4; X7 is an integer from about 9 to about 15; NX7, NX6, and NX3 are complementary to NX4 and NX5, and (a) any pyridmidine nucleotides present in the antisense strand (lower strand) are 2'-deoxy-2'-fluoro nucleotides; any purine nucleotides present in the antisense strand (lower strand) other than the purines nucleotides in the [N] nucleotide positions, are independently 2'-O-methyl nucleotides, 2'-deoxyribonucleotides- or a combination of 2'-deoxyribonucleotides and 2'-O-methyl nucleotides;

(b) any pyrimidine nucleotides present in the sense strand (upper strand) are 2'-deoxy-2'-fluoro nucleotides other than [N] nucleotides; any purine nucleotides present in the sense strand (upper strand) are independently 2'-deoxyribonucleotides, 2'-O-methyl nucleotides or a combination of 2'-deoxyribonucleotides and 2'-O-methyl nucleotides other than [N] nucleotides; and (c) any (N) nucleotides are optionally 2'-O-methyl, 2'-deoxy-2'-fluoro, or deoxyribonucleotides.

In one embodiment, the invention features a double stranded nucleic acid molecule having structure SIX:

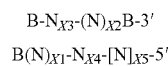

B-N$_{X3}$-(N)$_{X2}$B-3'

B(N)$_{X1}$-N$_{X4}$-[N]$_{X5}$-5'

SIX wherein each N is independently a nucleotide which can be unmodified or chemically modified; each B is a terminal cap moiety that can be present or absent; (N) represents non-base paired or overhanging nucleotides which can be unmodified or chemically modified; [N] represents nucleotide positions that are ribonucleotides; X1 and X2 are independently integers from about 0 to about 4; X3 is an integer from about 9 to about 30; X4 is an integer from about 11 to about 30, provided that the sum of X4 and X5 is between 17-36; X5 is an integer from about 1 to about 6; NX3 is complementary to NX4 and NX5, and (a) any pyridmidine nucleotides present in the antisense strand (lower strand) are 2'-deoxy-2'-fluoro nucleotides; any purine nucleotides present in the antisense strand (lower strand) other than the purines nucleotides in the [N] nucleotide positions, are independently 2'-O-methyl nucleotides, 2'-deoxyribonucleotides or a combination of 2'-deoxyribonucleotides and 2'-O-methyl nucleotides;

(b) any pyrimidine nucleotides present in the sense strand (upper strand) are 2'-deoxy-2'-fluoro nucleotides; any purine nucleotides present in the sense strand (upper strand) are independently 2'-deoxyribonucleotides, 2'-O-methyl nucleotides or a combination of 2'-deoxyribonucleotides and 2'-O-methyl nucleotides; and (c) any (N) nucleotides are optionally 2'-O-methyl, 2'-deoxy-2'-fluoro, or deoxyribonucleotides.

In one embodiment, the invention features a double stranded nucleic acid molecule having structure SX:

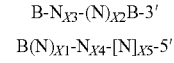

B-N$_{X3}$-(N)$_{X2}$B-3'

B(N)$_{X1}$-N$_{X4}$-[N]$_{X5}$-5'

SX wherein each N is independently a nucleotide which can be unmodified or chemically modified; each B is a terminal cap moiety that can be present or absent; (N) represents non-base paired or overhanging nucleotides which can be unmodified or chemically modified; [N] represents nucleotide positions that are ribonucleotides; X1 and X2 are independently integers from about 0 to about 4; X3 is an integer from about 9 to about 30; X4 is an integer from about 11 to about 30, provided that the sum of X4 and X5 is between 17-36; X5 is an integer from about 1 to about 6; NX3 is complementary to NX4 and NX5, and (a) any pyridmidine nucleotides present in the antisense strand (lower strand) are 2'-deoxy-2'-fluoro nucleotides; any purine nucleotides present in the antisense strand (lower strand) other than the purines nucleotides in the [N] nucleotide positions, are 2'-O-methyl nucleotides;

(b) any pyrimidine nucleotides present in the sense strand (upper strand) are ribonucleotides; any purine nucleotides present in the sense strand (upper strand) are ribonucleotides; and (c) any (N) nucleotides are optionally 2'-O-methyl, 2'-deoxy-2'-fluoro, or deoxyribonucleotides.

In one embodiment, the invention features a double stranded nucleic acid molecule having structure SXI:

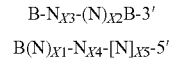

B-N$_{X3}$-(N)$_{X2}$B-3'

B(N)$_{X1}$-N$_{X4}$-[N]$_{X5}$-5'

SXI wherein each N is independently a nucleotide which can be unmodified or chemically modified; each B is a terminal cap moiety that can be present or absent; (N) represents non-base paired or overhanging nucleotides which can be unmodified or chemically modified; [N] represents nucleotide positions that are ribonucleotides; X1 and X2 are independently integers from about 0 to about 4; X3 is an integer from about 9 to about 30; X4 is an integer from about 11 to about 30, provided that the sum of X4 and X5 is between 17-36; X5 is an integer from about 1 to about 6; NX3 is complementary to NX4 and NX5, and (a) any pyridmidine nucleotides present in the antisense strand (lower strand) are 2'-deoxy-2'-fluoro nucleotides; any purine nucleotides present in the antisense strand (lower strand) other than the purines nucleotides in the [N] nucleotide positions, are 2'-O-methyl nucleotides;

(b) any pyrimidine nucleotides present in the sense strand (upper strand) are 2'-deoxy-2'-fluoro nucleotides; any purine nucleotides present in the sense strand (upper strand) are ribonucleotides; and (c) any (N) nucleotides are optionally 2'-O-methyl, 2'-deoxy-2'-fluoro, or deoxyribonucleotides.

In one embodiment, the invention features a double stranded nucleic acid molecule having structure SXII:

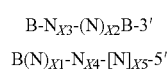

SXII wherein each N is independently a nucleotide which can be unmodified or chemically modified; each B is a terminal cap moiety that can be present or absent; (N) represents non-base paired or overhanging nucleotides which can be unmodified or chemically modified; [N] represents nucleotide positions that are ribonucleotides; X1 and X2 are independently integers from about 0 to about 4; X3 is an integer from about 9 to about 30; X4 is an integer from about 11 to about 30, provided that the sum of X4 and X5 is between 17-36; X5 is an integer from about 1 to about 6; NX3 is complementary to NX4 and NX5, and (a) any pyridmidine nucleotides present in the antisense strand (lower strand) are 2'-deoxy-2'-fluoro nucleotides; any purine nucleotides present in the antisense strand (lower strand) other than the purines nucleotides in the [N] nucleotide positions, are 2'-O-methyl nucleotides;

(b) any pyrimidine nucleotides present in the sense strand (upper strand) are 2'-deoxy-2'-fluoro nucleotides; any purine nucleotides present in the sense strand (upper strand) are deoxyribonucleotides; and (c) any (N) nucleotides are optionally 2'-O-methyl, 2'-deoxy-2'-fluoro, or deoxyribonucleotides.

In one embodiment, the invention features a double stranded nucleic acid molecule having structure SXIII:

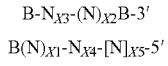

SXIII wherein each N is independently a nucleotide which can be unmodified or chemically modified; each B is a terminal cap moiety that can be present or absent; (N) represents non-base paired or overhanging nucleotides which can be unmodified or chemically modified; [N] represents nucleotide positions that are ribonucleotides; X1 and X2 are independently integers from about 0 to about 4; X3 is an integer from about 9 to about 30; X4 is an integer from about 11 to about 30, provided that the sum of X4 and X5 is between 17-36; X5 is an integer from about 1 to about 6; NX3 is complementary to NX4 and NX5, and (a) any pyridmidine nucleotides present in the antisense strand (lower strand) are nucleotides having a ribo-like configuration (e.g., Northern or A-form helix configuration); any purine nucleotides present in the antisense strand (lower strand) other than the purines nucleotides in the [N] nucleotide positions, are 2'-O-methyl nucleotides;

(b) any pyrimidine nucleotides present in the sense strand (upper strand) are nucleotides having a ribo-like configuration (e.g., Northern or A-form helix configuration); any purine nucleotides present in the sense strand (upper strand) are 2'-O-methyl nucleotides; and (c) any (N) nucleotides are optionally 2'-O-methyl, 2'-deoxy-2'-fluoro, or deoxyribonucleotides.

In one embodiment, the invention features a double stranded nucleic acid molecule having structure SXIV:

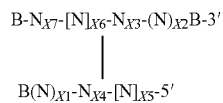

SXIV wherein each N is independently a nucleotide which can be unmodified or chemically modified; each B is a terminal cap moiety that can be present or absent; (N) represents non-base paired or overhanging nucleotides which can be unmodified or chemically modified; [N] represents nucleotide positions that are ribonucleotides; [N] represents nucleotide positions that are ribonucleotides; X1 and X2 are independently integers from about 0 to about 4; X3 is an integer from about 9 to about 15; X4 is an integer from about 11 to about 30, provided that the sum of X4 and X5 is between 17-36; X5 is an integer from about 1 to about 6; X6 is an integer from about 1 to about 4; X7 is an integer from about 9 to about 15; NX7, NX6, and NX3 are complementary to NX4 and NX5, and (a) any pyridmidine nucleotides present in the antisense strand (lower strand) are 2'-deoxy-2'-fluoro nucleotides; any purine nucleotides present in the antisense strand (lower strand) other than the purines nucleotides in the [N] nucleotide positions, are independently 2'-O-methyl nucleotides, 2'-deoxyribonucleotides or a combination of 2'-deoxyribonucleotides and 2'-O-methyl nucleotides;

(b) any pyrimidine nucleotides present in the sense strand (upper strand) are 2'-deoxy-2'-fluoro nucleotides other than [N] nucleotides; any purine nucleotides present in the sense strand (upper strand) are independently 2'-deoxyribonucleotides, 2'-O-methyl nucleotides or a combination of 2'-deoxyribonucleotides and 2'-O-methyl nucleotides other than [N] nucleotides; and (c) any (N) nucleotides are optionally 2'-O-methyl, 2'-deoxy-2'-fluoro, or deoxyribonucleotides.

In one embodiment, a double stranded nucleic acid molecule having any of structure SI, SII, SIII, SIV, SV, SVI, SVII, SVIII, SIX, SX, SXII, SXIII, or SXIV comprises a terminal phosphate group at the 5'-end of the antisense strand or antisense region of the nucleic acid molecule.

In one embodiment, a double stranded nucleic acid molecule having any of structure SI, SII, SIII, SIV, SV, SVI, SVII, SVIII, SIX, SX, SXII, SXIII, or SXIV comprises X5=1, 2, or 3; each X1 and X2=1 or 2; X3=12, 13, 14, 15, 16, 17, 18, 19, 20, 21, 22, 23, 24, 25, 26, 27, 28, 29, or 30, and X4=15, 16, 17, 18, 19, 20, 21, 22, 23, 24, 25, 26, 27, 28, 29, or 30.

In one embodiment, a double stranded nucleic acid molecule having any of structure SI, SII, SIII, SIV, SV, SVI, SVII, SVIII, SIX, SX, SXII, SXIII, or SXIV comprises X5=1; each X1 and X2=2; X3=19, and X4=18.

In one embodiment, a double stranded nucleic acid molecule having any of structure SI, SII, SIII, SIV, SV, SVI, SVII, SVIII, SIX, SX, SXII, SXIII, or SXIV comprises X5=2; each X1 and X2=2; X3=19, and X4=17

In one embodiment, a double stranded nucleic acid molecule having any of structure SI, SII, SIII, SIV, SV, SVI, SVII, SVIII, SIX, SX, SXII, SXIII, or SXIV comprises X5=3; each X1 and X2=2; X3=19, and X4=16.

In one embodiment, a double stranded nucleic acid molecule having any of structure SI, SII, SIII, SIV, SV, SVI, SVII, SVIII, SIX, SX, SXII, SXIII, or SXIV comprises B at the 3' and 5' ends of the sense strand or sense region.

In one embodiment, a double stranded nucleic acid molecule having any of structure SI, SII, SIII, SIV, SV, SVI, SVII, SVIII, SIX, SX, SXII, SXIII, or SXIV comprises B at the 3'-end of the antisense strand or antisense region.

In one embodiment, a double stranded nucleic acid molecule having any of structure SI, SII, SIII, SIV, SV, SVI, SVII, SVIII, SIX, SX, SXII, SXIII, or SXIV comprises B at the 3' and 5' ends of the sense strand or sense region and B at the 3'-end of the antisense strand or antisense region.

In one embodiment, a double stranded nucleic acid molecule having any of structure SI, SII, SIII, SIV, SV, SVI, SVII, SVIII, SIX, SX, SXII, SXIII, or SXIV further comprises one or more phosphorothioate internucleotide linkages at the first terminal (N) on the 3' end of the sense strand, antisense strand, or both sense strand and antisense strands of the nucleic acid molecule. For example, a double stranded nucleic acid molecule can comprise X1 and/or X2=2 having overhanging nucleotide positions with a phosphorothioate internucleotide linkage, e.g., (NsN) where "s" indicates phosphorothioate.

In one embodiment, a double stranded nucleic acid molecule having any of structure SI, SII, SIII, SIV, SV, SVI, SVII, SVIII, SIX, SX, SXII, SXIII, or SXIV comprises (N) nucleotides that are 2'-O-methyl nucleotides.

In one embodiment, a double stranded nucleic acid molecule having any of structure SI, SII, SIII, SIV, SV, SVI, SVII, SVIII, SIX, SX, SXII, SXIII, or SXIV comprises (N) nucleotides that are 2'-deoxy nucleotides.

In one embodiment, a double stranded nucleic acid molecule having any of structure SI, SII, SIII, SIV, SV, SVI, SVII, SVIII, SIX, SX, SXII, SXIII, or SXIV comprises (N) nucleotides in the antisense strand (lower strand) that are complementary to nucleotides in a target polynucleotide sequence (e.g., HCV target and/or HCV pathway/host target sequence) having complementary to the N and [N] nucleotides of the antisense (lower) strand.

In one embodiment, a double stranded nucleic acid molecule having any of structure SI, SII, SIII, SIV, SV, SVI, SVII, SVIII, SIX, SX, SXII, SXIII, or SXIV comprises (N) nucleotides in the sense strand (upper strand) that comprise a contiguous nucleotide sequence of about 15 to about 30 nucleotides of a target polynucleotide sequence (e.g., HCV target and/or HCV pathway/host target sequence).

In one embodiment, a double stranded nucleic acid molecule having any of structure SI, SII, SIII, SIV, SV, SVI, SVII, SVIII, SIX, SX, SXII, SXIII, or SXIV comprises (N) nucleotides in the sense strand (upper strand) that comprise nucleotide sequence corresponding a target polynucleotide sequence (e.g., HCV target and/or HCV pathway/host target sequence) having complementary to the antisense (lower) strand such that the contiguous (N) and N nucleotide sequence of the sense strand comprises nucleotide sequence of the target nucleic acid sequence (e.g., HCV target and/or HCV pathway/host target sequence).

In one embodiment, a double stranded nucleic acid molecule having any of structure SVIII or SXIV comprises B only at the 5'-end of the sense (upper) strand of the double stranded nucleic acid molecule.

In one embodiment, a double stranded nucleic acid molecule having any of structure SI, SII, SIII, SIV, SV, SVI, SVII, SVIII, SIX, SX, SXII, SXIII, or SXIV further comprises an unpaired terminal nucleotide at the 5'-end of the antisense (lower) strand. The unpaired nucleotide is not complementary to the sense (upper) strand. In one embodiment, the unpaired terminal nucleotide is complementary to a target polynucleotide sequence having complementary to the N and [N] nucleotides of the antisense strand. In another embodiment, the unpaired terminal nucleotide is not complementary to a target polynucleotide sequence having complementary to the N and [N] nucleotides of the antisense strand, if present.

In one embodiment, a double stranded nucleic acid molecule having any of structure SVIII or SXIV comprises X6=1 and X3=10.

In one embodiment, a double stranded nucleic acid molecule having any of structure SVIII or SXIV comprises X6=2 and X3=9.

In one embodiment, the invention features a composition comprising a siNA molecule or double stranded nucleic acid molecule or RNAi inhibitor formulated as any of formulation shown in Table VI, for example LNP-051; LNP-053; LNP-054; LNP-069; LNP-073; LNP-077; LNP-080; LNP-082; LNP-083; LNP-060; LNP-061; LNP-086; LNP-097; LNP-098; LNP-099; LNP-100; LNP-101; LNP-102; LNP-103; or LNP-104 (see Table VI).

In one embodiment, the invention features a composition comprising a first double stranded nucleic acid molecule and a second double stranded nucleic acid molecule each having a first strand and a second strand that are complementary to each other, wherein the second strand of the first double stranded nucleic acid molecule comprises sequence complementary to a first HCV sequence that is SEQ ID NO. 1444 and the second strand of the second double stranded nucleic acid molecule comprises sequence complementary to a second HCV sequence that is SEQ ID NO. 1417. In one embodiment, the composition further comprises a cationic lipid, a neutral lipid, and a polyethyleneglycol-conjugate. In one embodiment, the composition further comprises a cationic lipid, a neutral lipid, a polyethyleneglycol-conjugate, and a cholesterol. In one embodiment, the composition further comprises a polyethyleneglycol-conjugate, a cholesterol, and a surfactant. In one embodiment, the cationic lipid is selected from the group consisting of CLinDMA, pCLinDMA, eCLinDMA, DMOBA, and DMLBA. In one embodiment, the neutral lipid is selected from the group consisting of DSPC, DOBA, and cholesterol. In one embodiment, the polyethyleneglycol-conjugate is selected from the group consisting of a PEG-dimyristoyl glycerol and PEG-cholesterol. In one embodiment, the PEG is 2KPEG. In one embodiment, the surfactant is selected from the group consisting of palmityl alcohol, stearyl alcohol, oleyl alcohol and linoleyl alcohol. In one embodiment, the cationic lipid is CLinDMA, the neutral lipid is DSPC, the polyethylene glycol conjugate is 2 KPEG-DMG, the cholesterol is cholesterol, and the surfactant is linoleyl alcohol. In one embodiment, the CLinDMA, the DSPC, the 2 KPEG-DMG, the cholesterol, and the linoleyl alcohol are present in molar ratio of 43:38:10:2:7 respectively.

In one embodiment, the invention features a composition comprising a first double stranded nucleic and a second double stranded nucleic acid molecule each having a first strand and a second strand that are complementary to each other, wherein the second strand of the first double stranded nucleic acid molecule comprises sequence complementary to HCV sequence having SEQ ID NO: 1444 and the second strand of the second double stranded nucleic acid molecule comprises sequence complementary to HCV sequence having SEQ ID NO: 1417. In one embodiment, the composition further comprises a cationic lipid, a neutral lipid, and a polyethyleneglycol-conjugate. In one embodiment, the composition further comprises a cationic lipid, a neutral lipid, a polyethyleneglycol-conjugate, and a cholesterol. In one embodiment, the composition further comprises a polyethyleneglycol-conjugate, a cholesterol, and a surfactant. In one embodiment, the cationic lipid is selected from the group consisting of CLinDMA, pCLinDMA, eCLinDMA, DMOBA, and DMLBA. In one embodiment, the neutral lipid is selected from the group consisting of DSPC, DOBA, and cholesterol. In one embodiment, the polyethyleneglycol-conjugate is selected from the group consisting of a PEG-dimyristoyl glycerol and PEG-cholesterol. In one embodiment, the PEG is 2 KPEG. In one embodiment, the surfactant is selected from the group consisting of palmityl alcohol, stearyl alcohol, oleyl alcohol and linoleyl alcohol. In one embodiment, the cationic lipid is CLinDMA, the neutral lipid is DSPC, the polyethylene glycol conjugate is 2 KPEG-DMG, the cholesterol is cholesterol, and the surfactant is linoleyl alcohol. In one embodiment, the CLinDMA, the DSPC, the 2 KPEG-DMG, the cholesterol, and the linoleyl alcohol are present in molar ratio of 43:38:10:2:7 respectively. In one embodiment, the first strand and the second strand of the first double stranded nucleic acid molecule comprise SEQ ID NOs: 1796 and 2010 respectively, and the first strand and the second strand of the second double stranded nucleic acid molecule comprise SEQ ID NOs: 1677 and 2011 respectively. In one embodiment, the first strand and the second strand of the first double stranded nucleic acid molecule comprise SEQ ID NOs: 1796 and 2012 respectively, and the first strand and the second strand of the second double stranded nucleic acid molecule comprise SEQ ID NOs: 1677 and 2013 respectively. In one embodiment, the first strand and the second strand of the first double stranded nucleic acid molecule comprise SEQ ID NOs: 1796 and 2102 respectively, and the first strand and the second strand of the second double stranded nucleic acid molecule comprise SEQ ID NOs: 1677 and 2103 respectively.

In any of the embodiments herein, the siNA molecule of the invention modulates expression of one or more targets via RNA interference or the inhibition of RNA interference. In one embodiment, the RNA interference is RISC mediated cleavage of the target (e.g., siRNA mediated RNA interference). In one embodiment, the RNA interference is translational inhibition of the target (e.g., miRNA mediated RNA interference). In one embodiment, the RNA interference is transcriptional inhibition of the target (e.g., siRNA mediated transcriptional silencing). In one embodiment, the RNA interference takes place in the cytoplasm. In one embodiment, the RNA interference takes place in the nucleus.

In any of the embodiments herein, the siNA molecule of the invention modulates expression of one or more targets via inhibition of an endogenous target RNA, such as an endogenous mRNA, siRNA, miRNA, or alternately though inhibition of RISC.

In one embodiment, the invention features one or more RNAi inhibitors that modulate the expression of one or more gene targets by miRNA inhibition, siRNA inhibition, or RISC inhibition.

In one embodiment, a RNAi inhibitor of the invention is a siNA molecule as described herein that has one or more strands that are complementary to one or more target miRNA or siRNA molecules.

In one embodiment, the RNAi inhibitor of the invention is an antisense molecule that is complementary to a target miRNA or siRNA molecule or a portion thereof. An antisense RNAi inhibitor of the invention can be of length of about 10 to about 40 nucleotides in length (e.g., 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, or 40 nucleotides in length). An antisense RNAi inhibitor of the invention can comprise one or more modified nucleotides or non-nucleotides as described herein (see for example molecules having any of Formulae I-VII herein or any combination thereof). In one embodiment, an antisense RNAi inhibitor of the invention can comprise one or more or all 2'-O-methyl nucleotides. In one embodiment, an antisense RNAi inhibitor of the invention can comprise one or more or all 2'-deoxy-2'-fluoro nucleotides. In one embodiment, an antisense RNAi inhibitor of the invention can comprise one or more or all 2'-O-methoxy-ethyl (also known as 2'-methoxyethoxy or MOE) nucleotides. In one embodiment, an antisense RNAi inhibitor of the invention can comprise one or more or all phosphorothioate internucleotide linkages. In one embodiment, an antisense RNA inhibitor or the invention can comprise a terminal cap moiety at the 3'-end, the 5'-end, or both the 5' and 3' ends of the antisense RNA inhibitor.

In one embodiment, a RNAi inhibitor of the invention is a nucleic acid aptamer having binding affinity for RISC, such as a regulatable aptamer (see for example An et al., 2006, *RNA,* 12:710-716). An aptamer RNAi inhibitor of the invention can be of length of about 10 to about 50 nucleotides in length (e.g., 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50 nucleotides in length). An aptamer RNAi inhibitor of the invention can comprise one or more modified nucleotides or non-nucleotides as described herein (see for example molecules having any of Formulae I-VII herein or any combination thereof). In one embodiment, an aptamer RNAi inhibitor of the invention can comprise one or more or all 2'-O-methyl nucleotides. In one embodiment, an aptamer RNAi inhibitor of the invention can comprise one or more or all 2'-deoxy-2'-fluoro nucleotides. In one embodiment, an aptamer RNAi inhibitor of the invention can comprise one or more or all 2'-O-methoxy-ethyl (also known as 2'-methoxyethoxy or MOE) nucleotides. In one embodiment, an aptamer RNAi inhibitor of the invention can comprise one or more or all phosphorothioate internucleotide linkages. In one embodiment, an aptamer RNA inhibitor or the invention can comprise a terminal cap moiety at the 3'-end, the 5;'-end, or both the 5' and 3' ends of the aptamer RNA inhibitor.

In one embodiment, the invention features a method for modulating the expression of a HCV target gene within a cell comprising: (a) synthesizing a siNA molecule of the invention, which can be chemically-modified or unmodified, wherein one of the siNA strands comprises a sequence complementary to RNA of the HCV target gene; and (b) introducing the siNA molecule into a cell under conditions suitable to modulate (e.g., inhibit) the expression of the HCV target gene in the cell.

In one embodiment, the invention features a method for modulating the expression of a HCV target gene within a cell comprising: (a) synthesizing a siNA molecule of the invention, which can be chemically-modified or unmodified, wherein one of the siNA strands comprises a sequence complementary to RNA of the HCV target gene and wherein the sense strand sequence of the siNA comprises a sequence identical or substantially similar to the sequence of the HCV target RNA; and (b) introducing the siNA molecule into a cell under conditions suitable to modulate (e.g., inhibit) the expression of the HCV target gene in the cell.

In another embodiment, the invention features a method for modulating the expression of more than one HCV target gene within a cell comprising: (a) synthesizing siNA molecules of the invention, which can be chemically-modified or unmodified, wherein one of the siNA strands comprises a sequence complementary to RNA of the HCV target genes; and (b)

introducing the siNA molecules into a cell under conditions suitable to modulate (e.g., inhibit) the expression of the HCV target genes in the cell.

In another embodiment, the invention features a method for modulating the expression of two or more HCV target genes within a cell comprising: (a) synthesizing one or more siNA molecules of the invention, which can be chemically-modified or unmodified, wherein the siNA strands comprise sequences complementary to RNA of the HCV target genes and wherein the sense strand sequences of the siNAs comprise sequences identical or substantially similar to the sequences of the HCV target RNAs; and (b) introducing the siNA molecules into a cell under conditions suitable to modulate (e.g., inhibit) the expression of the HCV target genes in the cell.

In another embodiment, the invention features a method for modulating the expression of more than one HCV target gene within a cell comprising: (a) synthesizing a siNA molecule of the invention, which can be chemically-modified or unmodified, wherein one of the siNA strands comprises a sequence complementary to RNA of the HCV target gene and wherein the sense strand sequence of the siNA comprises a sequence identical or substantially similar to the sequences of the HCV target RNAs; and (b) introducing the siNA molecule into a cell under conditions suitable to modulate (e.g., inhibit) the expression of the HCV target genes in the cell.

In one embodiment, siNA molecules of the invention are used as reagents in ex vivo applications. For example, siNA reagents are introduced into tissue or cells that are transplanted into a subject for therapeutic effect. The cells and/or tissue can be derived from an organism or subject that later receives the explant, or can be derived from another organism or subject prior to transplantation. The siNA molecules can be used to modulate the expression of one or more genes in the cells or tissue, such that the cells or tissue obtain a desired phenotype or are able to perform a function when transplanted in vivo. In one embodiment, certain target cells (e.g. liver cells) from a patient are extracted. These extracted cells are contacted with siNAs targeting a specific nucleotide sequence within the cells under conditions suitable for uptake of the siNAs by these cells (e.g. using delivery reagents such as cationic lipids, liposomes and the like or using techniques such as electroporation to facilitate the delivery of siNAs into cells). The cells are then reintroduced back into the same patient or other patients.

In one embodiment, the invention features a method of modulating the expression of a target gene in a tissue explant (e.g., liver or any other organ, tissue or cell as can be transplanted from one organism to another or back to the same organism from which the organ, tissue or cell is derived) comprising: (a) synthesizing a siNA molecule of the invention, which can be chemically-modified, wherein one of the siNA strands comprises a sequence complementary to RNA of the target gene; and (b) introducing the siNA molecule into a cell of the tissue explant derived from a particular organism under conditions suitable to modulate (e.g., inhibit) the expression of the target gene in the tissue explant. In another embodiment, the method further comprises introducing the tissue explant back into the organism the tissue was derived from or into another organism under conditions suitable to modulate (e.g., inhibit) the expression of the target gene in that organism.

In one embodiment, the invention features a method of modulating the expression of a target gene in a tissue explant (e.g., liver or any other organ, tissue or cell as can be transplanted from one organism to another or back to the same organism from which the organ, tissue or cell is derived) comprising: (a) synthesizing a siNA molecule of the invention, which can be chemically-modified, wherein one of the siNA strands comprises a sequence complementary to RNA of the target gene and wherein the sense strand sequence of the siNA comprises a sequence identical or substantially similar to the sequence of the target RNA; and (b) introducing the siNA molecule into a cell of the tissue explant derived from a particular organism under conditions suitable to modulate (e.g., inhibit) the expression of the target gene in the tissue explant. In another embodiment, the method further comprises introducing the tissue explant back into the organism the tissue was derived from or into another organism under conditions suitable to modulate (e.g., inhibit) the expression of the target gene in that organism.

In another embodiment, the invention features a method of modulating the expression of more than one target gene in a tissue explant (e.g., liver or any other organ, tissue or cell as can be transplanted from one organism to another or back to the same organism from which the organ, tissue or cell is derived) comprising: (a) synthesizing siNA molecules of the invention, which can be chemically-modified, wherein one of the siNA strands comprises a sequence complementary to RNA of the target genes; and (b) introducing the siNA molecules into a cell of the tissue explant derived from a particular organism under conditions suitable to modulate (e.g., inhibit) the expression of the target genes in the tissue explant. In another embodiment, the method further comprises introducing the tissue explant back into the organism the tissue was derived from or into another organism under conditions suitable to modulate (e.g., inhibit) the expression of the target genes in that organism.

In one embodiment, the invention features a method of modulating the expression of a target gene in a subject or organism comprising: (a) synthesizing a siNA molecule of the invention, which can be chemically-modified, wherein one of the siNA strands comprises a sequence complementary to RNA of the target gene; and (b) introducing the siNA molecule into the subject or organism under conditions suitable to modulate (e.g., inhibit) the expression of the target gene in the subject or organism. The level of target protein or RNA can be determined using various methods well-known in the art.

In another embodiment, the invention features a method of modulating the expression of more than one target gene in a subject or organism comprising: (a) synthesizing siNA molecules of the invention, which can be chemically-modified, wherein one of the siNA strands comprises a sequence complementary to RNA of the target genes; and (b) introducing the siNA molecules into the subject or organism under conditions suitable to modulate (e.g., inhibit) the expression of the target genes in the subject or organism. The level of target protein or RNA can be determined as is known in the art.

In one embodiment, the invention features a method for modulating the expression of a target gene within a cell, (e.g., a liver cell) comprising: (a) synthesizing a siNA molecule of the invention, which can be chemically-modified, wherein the siNA comprises a single stranded sequence having complementarity to RNA of the target gene; and (b) introducing the siNA molecule into a cell under conditions suitable to modulate (e.g., inhibit) the expression of the target gene in the cell.

In another embodiment, the invention features a method for modulating the expression of more than one HCV target gene within a cell (e.g., a liver cell) comprising: (a) synthesizing siNA molecules of the invention, which can be chemically-modified, wherein the siNA comprises a single stranded sequence having complementarity to RNA of the HCV target gene; and (b) contacting the cell in vitro or in vivo with the siNA molecule under conditions suitable to modulate (e.g., inhibit) the expression of the HCV target genes in the cell.

In one embodiment, the invention features a method of modulating the expression of a HCV target gene in a tissue explant ((e.g., liver or any other organ, tissue or cell as can be transplanted from one organism to another or back to the same organism from which the organ, tissue or cell is derived) comprising: (a) synthesizing a siNA molecule of the invention, which can be chemically-modified, wherein the siNA comprises a single stranded sequence having complementarity to RNA of the HCV target gene; and (b) contacting a cell of the tissue explant derived from a particular subject or organism with the siNA molecule under conditions suitable to modulate (e.g., inhibit) the expression of the HCV target gene in the tissue explant. In another embodiment, the method further comprises introducing the tissue explant back into the subject or organism the tissue was derived from or into another subject or organism under conditions suitable to modulate (e.g., inhibit) the expression of the HCV target gene in that subject or organism.

In another embodiment, the invention features a method of modulating the expression of more than one HCV target gene in a tissue explant (e.g., liver or any other organ, tissue or cell as can be transplanted from one organism to another or back to the same organism from which the organ, tissue or cell is derived) comprising: (a) synthesizing siNA molecules of the invention, which can be chemically-modified, wherein the siNA comprises a single stranded sequence having complementarity to RNA of the HCV target gene; and (b) introducing the siNA molecules into a cell of the tissue explant derived from a particular subject or organism under conditions suitable to modulate (e.g., inhibit) the expression of the HCV target genes in the tissue explant. In another embodiment, the method further comprises introducing the tissue explant back into the subject or organism the tissue was derived from or into another subject or organism under conditions suitable to modulate (e.g., inhibit) the expression of the HCV target genes in that subject or organism.

In one embodiment, the invention features a method of modulating the expression of a HCV target gene in a subject or organism comprising: (a) synthesizing a siNA molecule of the invention, which can be chemically-modified, wherein the siNA comprises a single stranded sequence having complementarity to RNA of the HCV target gene; and (b) introducing the siNA molecule into the subject or organism under conditions suitable to modulate (e.g., inhibit) the expression of the HCV target gene in the subject or organism.

In another embodiment, the invention features a method of modulating the expression of more than one HCV target gene in a subject or organism comprising: (a) synthesizing siNA molecules of the invention, which can be chemically-modified, wherein the siNA comprises a single stranded sequence having complementarity to RNA of the HCV target gene; and (b) introducing the siNA molecules into the subject or organism under conditions suitable to modulate (e.g., inhibit) the expression of the HCV target genes in the subject or organism.

In one embodiment, the invention features a method of modulating the expression of a HCV target gene in a subject or organism comprising contacting the subject or organism with a siNA molecule of the invention under conditions suitable to modulate (e.g., inhibit) the expression of the HCV target gene in the subject or organism.

In one embodiment, the invention features a method for treating or preventing a disease, disorder, trait or condition related to gene expression or activity in a subject or organism comprising contacting the subject or organism with a siNA molecule of the invention under conditions suitable to modulate the expression of the target gene in the subject or organism. The reduction of gene expression and thus reduction in the level of the respective protein/RNA relieves, to some extent, the symptoms of the disease, disorder, trait or condition.

In one embodiment, the invention features a method for treating or preventing HCV infection in a subject or organism comprising contacting the subject or organism with a siNA molecule of the invention under conditions suitable to modulate the expression of the HCV target gene in the subject or organism whereby the treatment or prevention of HCV infection can be achieved. In one embodiment, the invention features contacting the subject or organism with a siNA molecule of the invention via local administration to relevant tissues or cells, such as liver cells and tissues. In one embodiment, the invention features contacting the subject or organism with a siNA molecule of the invention via systemic administration (such as via intravenous or subcutaneous administration of siNA) to relevant tissues or cells, such as tissues or cells involved in the maintenance or development of HCV infection in a subject or organism. The siNA molecule of the invention can be formulated or conjugated as described herein or otherwise known in the art to target appropriate tissues or cells in the subject or organism. The siNA molecule can be combined with other therapeutic treatments and modalities as are known in the art for the treatment of or prevention of HCV infection in a subject or organism.

In one embodiment, the invention features a method for treating or preventing a liver failure or condition in a subject or organism comprising contacting the subject or organism with a siNA molecule of the invention under conditions suitable to modulate the expression of the HCV target gene in the subject or organism whereby the treatment or prevention of the liver failure or condition can be achieved. In one embodiment, the invention features contacting the subject or organism with a siNA molecule of the invention via local administration to relevant tissues or cells, such as liver cells and tissues involved in liver failure. In one embodiment, the invention features contacting the subject or organism with a siNA molecule of the invention via systemic administration (such as via intravenous or subcutaneous administration of siNA) to relevant tissues or cells, such as tissues or cells involved in the maintenance or development of the liver failure or condition in a subject or organism. The siNA molecule of the invention can be formulated or conjugated as described herein or otherwise known in the art to target appropriate tissues or cells in the subject or organism. The siNA molecule can be combined with other therapeutic treatments and modalities as are known in the art for the treatment of or prevention of liver failures, traits, disorders, or conditions in a subject or organism.

In one embodiment, the invention features a method for treating or preventing hepatocellular carcinoma in a subject or organism comprising contacting the subject or organism with a siNA molecule of the invention under conditions suitable to modulate the expression of the HCV target gene in the subject or organism whereby the treatment or prevention of hepatocellular carcinoma can be achieved. In one embodiment, the invention features contacting the subject or organism with a siNA molecule of the invention via local administration to relevant tissues or cells, such as liver cells and tissues involved in hepatocellular carcinoma. In one embodiment, the invention features contacting the subject or organism with a siNA molecule of the invention via systemic administration (such as via intravenous or subcutaneous administration of siNA) to relevant tissues or cells, such as tissues or cells involved in the maintenance or development of hepatocellular carcinoma in a subject or organism. The siNA molecule of the invention can be formulated or conjugated as described herein or otherwise known in the art to target appropriate tissues or cells in the subject or organism. The siNA molecule can be combined with other therapeutic treatments and modalities as are known in the art for the treatment of or prevention of hepatocellular carcinoma in a subject or organism.

In one embodiment, the invention features a method for treating or preventing an cirrhosis, disorder, trait or condition in a subject or organism comprising contacting the subject or organism with a siNA molecule of the invention under conditions suitable to modulate the expression of the HCV target gene in the subject or organism whereby the treatment or prevention of the cirrhosis, disorder, trait or condition can be achieved. In one embodiment, the invention features contacting the subject or organism with a siNA molecule of the invention via local administration to relevant tissues or cells, such as cells and tissues involved in the cirrhosis, disorder, trait or condition. In one embodiment, the invention features contacting the subject or organism with a siNA molecule of the invention via systemic administration (such as via intravenous or subcutaneous administration of siNA) to relevant tissues or cells, such as tissues or cells involved in the maintenance or development of the cirrhosis, disorder, trait or condition in a subject or organism. The siNA molecule of the invention can be formulated or conjugated as described herein or otherwise known in the art to target appropriate tissues or cells in the subject or organism. The siNA molecule can be combined with other therapeutic treatments and modalities as are known in the art for the treatment of or prevention of cirrhosiss, traits, disorders, or conditions in a subject or organism.

In one embodiment, the invention features a method for treating or preventing HCV infection in a subject or organism comprising contacting the subject or organism with a siNA molecule of the invention under conditions suitable to modulate the expression of an inhibitor of HCV gene expression in the subject or organism.

In one embodiment, the invention features a method for treating or preventing liver failure in a subject or organism comprising contacting the subject or organism with a siNA molecule of the invention under conditions suitable to modulate the expression of an inhibitor of HCV gene expression in the subject or organism.

In one embodiment, the invention features a method for treating or preventing hepatocellular carcinoma in a subject or organism comprising contacting the subject or organism with a siNA molecule of the invention under conditions suitable to modulate the expression of an inhibitor of HCV gene expression in the subject or organism.

In one embodiment, the invention features a method for treating or preventing cirrhosis in a subject or organism comprising contacting the subject or organism with a siNA molecule of the invention under conditions suitable to modulate the expression of an inhibitor of HCV gene expression in the subject or organism.

In one embodiment, the invention features a method for treating or preventing Hepatitis C Virus (HCV) infection in a subject, comprising administering to the subject PEG Interferon in combination with a siNA molecule of the invention; wherein the PEG Interferon and the siNA molecule are administered under conditions suitable for reducing or inhibiting the level of Hepatitis C Virus (HCV) in the subject compared to a subject not treated with the PEG Interferon and the siNA molecule. In one embodiment, a siNA molecule of the invention is formulated as a composition described in U.S. Provisional patent application No. 60/678,531 and in related U.S. Provisional patent application No. 60/703,946, filed Jul. 29, 2005, U.S. Provisional patent application No. 60/737,024, filed Nov. 15, 2005, and U.S. Ser. No. 11/353,630, filed Feb. 14, 2006 (Vargeese et al.).

In one embodiment, the invention features a method for treating or preventing Hepatitis C Virus (HCV) infection in a subject, comprising administering to the subject ribavirin in combination with a siNA molecule of the invention; wherein the ribavirin and the siNA are administered under conditions suitable for reducing or inhibiting the level of Hepatitis C Virus (HCV) in the subject compared to a subject not treated with the ribavirin and the siNA molecule.

In one embodiment, the invention features a method for treating or preventing Hepatitis C Virus (HCV) infection in a subject, comprising administering to the subject PEG Interferon and ribavirin in combination with a siNA molecule of the invention; wherein the PEG Interferon and ribavirin and the siNA molecule are administered under conditions suitable for reducing or inhibiting the level of Hepatitis C Virus (HCV) in the subject compared to a subject not treated with the PEG Interferon and ribavirin and the siNA molecule.

In one embodiment, the invention features a method for treating or preventing Hepatitis C Virus (HCV) infection in a subject, comprising administering to the subject PEG Interferon in combination with a chemically synthesized double stranded nucleic acid molecule; wherein (a) the double stranded nucleic acid molecule comprises a sense strand and an antisense strand; (b) each strand of the double stranded nucleic acid molecule is 15 to 28 nucleotides in length; (c) at least 15 nucleotides of the sense strand are complementary to the antisense strand(d) the antisense strand of the double stranded nucleic acid molecule has complementarity to a Hepatitis C Virus (HCV) HCV target RNA; and wherein the PEG Interferon and the double stranded nucleic acid molecule are administered under conditions suitable for reducing or inhibiting the level of Hepatitis C Virus (HCV) in the subject compared to a subject not treated with the PEG Interferon and the double stranded nucleic acid molecule.

In one embodiment, the invention features a method for treating or preventing Hepatitis C Virus (HCV) infection in a subject, comprising administering to the subject ribavirin in combination with a chemically synthesized double stranded nucleic acid molecule; wherein (a) the double stranded nucleic acid molecule comprises a sense strand and an antisense strand; (b) each strand of the double stranded nucleic acid molecule is 15 to 28 nucleotides in length; (c) at least 15 nucleotides of the sense strand are complementary to the antisense strand(d) the antisense strand of the double stranded nucleic acid molecule has complementarity to a Hepatitis C Virus (HCV) HCV target RNA; and wherein the ribavirin and the double stranded nucleic acid molecule are administered under conditions suitable for reducing or inhibiting the level of Hepatitis C Virus (HCV) in the subject compared to a subject not treated with the ribavirin and the double stranded nucleic acid molecule.

In one embodiment, the invention features a method for treating or preventing Hepatitis C Virus (HCV) infection in a subject, comprising administering to the subject PEG Interferon and ribavirin in combination with a chemically synthesized double stranded nucleic acid molecule; wherein (a) the double stranded nucleic acid molecule comprises a sense strand and an antisense strand; (b) each strand of the double stranded nucleic acid molecule is 15 to 28 nucleotides in length; (c) at least 15 nucleotides of the sense strand are complementary to the antisense strand(d) the antisense strand of the double stranded nucleic acid molecule has complementarity to a Hepatitis C Virus (HCV) HCV target RNA; and wherein the PEG Interferon and ribavirin and the double stranded nucleic acid molecule are administered under conditions suitable for reducing or inhibiting the level of Hepatitis C Virus (HCV) in the subject compared to a subject not treated with the PEG Interferon and ribavirin and the double stranded nucleic acid molecule.

In one embodiment, the invention features a method for treating or preventing Hepatitis C Virus (HCV) infection in a subject, comprising administering to the subject PEG Interferon in combination with a chemically synthesized double stranded nucleic acid molecule; wherein (a) the double stranded nucleic acid molecule comprises a sense strand and an antisense strand; (b) each strand of the double stranded nucleic acid molecule is 15 to 28 nucleotides in length; (c) at least 15 nucleotides of the sense strand are complementary to the antisense strand(d) the antisense strand of the double stranded nucleic acid molecule has complementarity to a Hepatitis C Virus (HCV) HCV target RNA; (e) at least 20% of the internal nucleotides of each strand of the double stranded nucleic acid molecule are modified nucleosides having a chemical modification; and (f) at least two of the chemical modifications are different from each other, and wherein the PEG Interferon and the double stranded nucleic acid molecule are administered under conditions suitable for reducing or inhibiting the level of Hepatitis C Virus (HCV) in the subject compared to a subject not treated with the PEG Interferon and the double stranded nucleic acid molecule.

In one embodiment, the invention features a method for treating or preventing Hepatitis C Virus (HCV) infection in a subject, comprising administering to the subject ribavirin in combination with a chemically synthesized double stranded nucleic acid molecule; wherein (a) the double stranded nucleic acid molecule comprises a sense strand and an antisense strand; (b) each strand of the double stranded nucleic acid molecule is 15 to 28 nucleotides in length; (c) at least 15 nucleotides of the sense strand are complementary to the antisense strand(d) the antisense strand of the double stranded nucleic acid molecule has complementarity to a Hepatitis C Virus (HCV) HCV target RNA; (e) at least 20% of the internal nucleotides of each strand of the double stranded nucleic acid molecule are modified nucleosides having a chemical modification; and (f) at least two of the chemical modifications are different from each other, and wherein the ribavirin and the double stranded nucleic acid molecule are administered under conditions suitable for reducing or inhibiting the level of Hepatitis C Virus (HCV) in the subject compared to a subject not treated with the ribavirin and the double stranded nucleic acid molecule.

In one embodiment, the invention features a method for treating or preventing Hepatitis C Virus (HCV) infection in a subject, comprising administering to the subject PEG Interferon and ribavirin in combination with a chemically synthesized double stranded nucleic acid molecule; wherein (a) the double stranded nucleic acid molecule comprises a sense strand and an antisense strand; (b) each strand of the double stranded nucleic acid molecule is 15 to 28 nucleotides in length; (c) at least 15 nucleotides of the sense strand are complementary to the antisense strand(d) the antisense strand of the double stranded nucleic acid molecule has complementarity to a Hepatitis C Virus (HCV) HCV target RNA; (e) at least 20% of the internal nucleotides of each strand of the double stranded nucleic acid molecule are modified nucleosides having a chemical modification; and (f) at least two of the chemical modifications are different from each other, and wherein the PEG Interferon and ribavirin and the double stranded nucleic acid molecule are administered under conditions suitable for reducing or inhibiting the level of Hepatitis C Virus (HCV) in the subject compared to a subject not treated with the PEG Interferon and ribavirin and the double stranded nucleic acid molecule.

In one embodiment, the invention features a method for treating or preventing Hepatitis C Virus (HCV) infection in a subject, comprising administering to the subject PEG Interferon in combination with a chemically synthesized double stranded nucleic acid molecule; wherein (a) the double stranded nucleic acid molecule comprises a sense strand and an antisense strand; (b) each strand of the double stranded nucleic acid molecule is 15 to 28 nucleotides in length; (c) at least 15 nucleotides of the sense strand are complementary to the antisense strand(d) the antisense strand of the double stranded nucleic acid molecule has complementarity to a Hepatitis C Virus (HCV) HCV target RNA; (e) at least 20% of the internal nucleotides of each strand of the double stranded nucleic acid molecule are modified nucleosides having a sugar modification; and (f) at least two of the sugar modifications are different from each other, and wherein the PEG Interferon and the double stranded nucleic acid molecule are administered under conditions suitable for reducing or inhibiting the level of Hepatitis C Virus (HCV) in the subject compared to a subject not treated with the PEG Interferon and the double stranded nucleic acid molecule.

In one embodiment, the invention features a method for treating or preventing Hepatitis C Virus (HCV) infection in a subject, comprising administering to the subject ribavirin in combination with a chemically synthesized double stranded nucleic acid molecule; wherein (a) the double stranded nucleic acid molecule comprises a sense strand and an antisense strand; (b) each strand of the double stranded nucleic acid molecule is 15 to 28 nucleotides in length; (c) at least 15 nucleotides of the sense strand are complementary to the antisense strand(d) the antisense strand of the double stranded nucleic acid molecule has complementarity to a Hepatitis C Virus (HCV) HCV target RNA; (e) at least 20% of the internal nucleotides of each strand of the double stranded nucleic acid molecule are modified nucleosides having a sugar modification; and (f) at least two of the sugar modifications are different from each other, and wherein the ribavirin and the double stranded nucleic acid molecule are administered under conditions suitable for reducing or inhibiting the level of Hepatitis C Virus (HCV) in the subject compared to a subject not treated with the ribavirin and the double stranded nucleic acid molecule.

In one embodiment, the invention features a method for treating or preventing Hepatitis C Virus (HCV) infection in a subject, comprising administering to the subject PEG Interferon and ribavirin in combination with a chemically synthesized double stranded nucleic acid molecule; wherein (a) the double stranded nucleic acid molecule comprises a sense strand and an antisense strand; (b) each strand of the double stranded nucleic acid molecule is 15 to 28 nucleotides in length; (c) at least 15 nucleotides of the sense strand are complementary to the antisense strand(d) the antisense strand of the double stranded nucleic acid molecule has complementarity to a Hepatitis C Virus (HCV) HCV target RNA; (e) at least 20% of the internal nucleotides of each strand of the double stranded nucleic acid molecule are modified nucleosides having a sugar modification; and (f) at least two of the sugar modifications are different from each other, and wherein the PEG Interferon and ribavirin and the double stranded nucleic acid molecule are administered under conditions suitable for reducing or inhibiting the level of Hepatitis C Virus (HCV) in the subject compared to a subject not treated with the PEG Interferon and ribavirin and the double stranded nucleic acid molecule.

In one embodiment, the invention features a composition comprising PEG Interferon and one or more double stranded nucleic acid molecules or siNA molecules of the invention in a pharmaceutically acceptable carrier or diluent. In another embodiment, the invention features a composition comprising PEG Interferon, ribavirin, Vertex VX-950, Actilon (CPG 10101), and/or Isatoribine (TLR-7 agonist) and one or more double stranded nucleic acid molecules or siNA molecules of the invention in a pharmaceutically acceptable carrier or diluent.

In one embodiment, a method of treatment of the invention features administration of a double stranded nucleic acid molecule of the invention in combination with one or more other therapeutic modalities, including Interferon (e.g., Interferon-alpha, or PEG interferon such as PEG-Intron, Rebetol, Rebetron, or Pegasys), ribavirin, Vertex VX-950, Actilon (CPG 10101), or Isatoribine (TLR-7 agonist). In another embodiment, such combination therapies can be utilized in any of the embodiments herein.

In any of the methods of treatment of the invention, the siNA can be administered to the subject as a course of treatment, for example administration at various time intervals, such as once per day over the course of treatment, once every two days over the course of treatment, once every three days over the course of treatment, once every four days over the course of treatment, once every five days over the course of treatment, once every six days over the course of treatment, once per week over the course of treatment, once every other week over the course of treatment, once per month over the course of treatment, etc. In one embodiment, the course of treatment is once every 1, 2, 3, 4; 5, 6, 7, 8, 9, or 10 weeks. In one embodiment, the course of treatment is from about one to about 52 weeks or longer (e.g., indefinitely). In one embodiment, the course of treatment is from about one to about 48 months or longer (e.g., indefinitely).

In one embodiment, a course of treatment involves an initial course of treatment, such as once every 1, 2, 3, 4, 5, 6, 7, 8, 9, 10 or more weeks for a fixed interval (e.g., 1×, 2×, 3×, 4×, 5×, 6×, 7×, 8×, 9×, 10× or more) followed by a maintenance course of treatment, such as once every 4, 6, 8, 10, 15, 20, 25, 30, 35, 40, or more weeks for an additional fixed interval (e.g., 1×, 2×, 3×, 4×, 5×, 6×, 7×, 8×, 9×, 10× or more).

In any of the methods of treatment of the invention, the siNA can be administered to the subject systemically as described herein or otherwise known in the art, either alone as a monotherapy or in combination with additional therapies described herein or as are known in the art. Systemic administration can include, for example, pulmonary (inhalation, nebulization etc.) intravenous, subcutaneous, intramuscular, catheterization, nasopharangeal, transdermal, or oral/gastrointestinal administration as is generally known in the art.

In one embodiment, in any of the methods of treatment or prevention of the invention, the siNA can be administered to the subject locally or to local tissues as described herein or otherwise known in the art, either alone as a monotherapy or in combination with additional therapies as are known in the art. Local administration can include, for example, inhalation, nebulization, catheterization, implantation, direct injection, dermal/transdermal application, stenting, ear/eye drops, or portal vein administration to relevant tissues, or any other local administration technique, method or procedure, as is generally known in the art.

In another embodiment, the invention features a method of modulating the expression of more than one HCV target gene in a subject or organism comprising contacting the subject or organism with one or more siNA molecules of the invention under conditions suitable to modulate (e.g., inhibit) the expression of the HCV target genes in the subject or organism.

The siNA molecules of the invention can be designed to down regulate or inhibit target gene expression through RNAi targeting of a variety of nucleic acid molecules. In one embodiment, the siNA molecules of the invention are used to target various DNA corresponding to a target gene, for example via heterochromatic silencing or transcriptional inhibition. In one embodiment, the siNA molecules of the invention are used to target various RNAs corresponding to a target gene, for example via RNA target cleavage or translational inhibition. Non-limiting examples of such RNAs include messenger RNA (mRNA), non-coding RNA (ncRNA) or regulatory elements (see for example Mattick, 2005, *Science,* 309, 1527-1528 and Clayerie, 2005, *Science,* 309, 1529-1530) which includes miRNA and other small RNAs, alternate RNA splice variants of target gene(s), post-transcriptionally modified RNA of target gene(s), pre-mRNA of target gene(s), and/or RNA templates. If alternate splicing produces a family of transcripts that are distinguished by usage of appropriate exons, the instant invention can be used to inhibit gene expression through the appropriate exons to specifically inhibit or to distinguish among the functions of gene family members. For example, a protein that contains an alternatively spliced transmembrane domain can be expressed in both membrane bound and secreted forms. Use of the invention to target the exon containing the transmembrane domain can be used to determine the functional consequences of pharmaceutical targeting of membrane bound as opposed to the secreted form of the protein. Non-limiting examples of applications of the invention relating to targeting these RNA molecules include therapeutic pharmaceutical applications, cosmetic applications, veterinary applications, pharmaceutical discovery applications, molecular diagnostic and gene function applications, and gene mapping, for example using single nucleotide polymorphism mapping with siNA molecules of the invention. Such applications can be implemented using known gene sequences or from partial sequences available from an expressed sequence tag (EST).

In another embodiment, the siNA molecules of the invention are used to target conserved sequences corresponding to a gene family or gene families such as HCV family genes (e.g., all known HCV strains, groups of related HCV strains, or groups of divergent HCV strains). As such, siNA molecules targeting multiple HCV targets can provide increased therapeutic effect. In addition, siNA can be used to characterize pathways of gene function in a variety of applications. For example, the present invention can be used to inhibit the activity of target gene(s) in a pathway to determine the function of uncharacterized gene(s) in gene function analysis, mRNA function analysis, or translational analysis. The invention can be used to determine potential target gene pathways involved in various diseases and conditions toward pharmaceutical development.

In addition, siNA can be used to characterize pathways of gene function in a variety of applications. For example, the present invention can be used to inhibit the activity of target gene(s) in a pathway to determine the function of uncharacterized gene(s) in gene function analysis, mRNA function analysis, or translational analysis. The invention can be used to determine potential target gene pathways involved in various diseases and conditions toward pharmaceutical development.

In one embodiment, siNA molecule(s) and/or methods of the invention are used to down regulate the expression of gene(s) that encode RNA referred to by Genbank Accession, for example, target genes encoding RNA sequence(s) referred to herein by Genbank Accession number, for example, Genbank Accession Nos. shown in Table I or Genbank Accession Nos. shown in PCT/US03/05028, U.S. Provisional Patent Application No. 60/363,124, or U.S. Ser. No. 10/923,536 and U.S. Ser. No. 10/444,853, all of which are incorporated by reference herein.

In one embodiment, the invention features a method comprising: (a) generating a library of siNA constructs having a predetermined complexity; and (b) assaying the siNA constructs of (a) above, under conditions suitable to determine RNAi target sites within the target RNA sequence. In one embodiment, the siNA molecules of (a) have strands of a fixed length, for example, about 23 nucleotides in length. In another embodiment, the siNA molecules of (a) are of differing length, for example having strands of about 15 to about 30 (e.g., about 15, 16, 17, 18, 19, 20, 21, 22, 23, 24, 25, 26, 27, 28, 29, or 30) nucleotides in length. In one embodiment, the assay can comprise a reconstituted in vitro siNA assay as described herein. In another embodiment, the assay can comprise a cell culture system in which target RNA is expressed. In another embodiment, fragments of target RNA are analyzed for detectable levels of cleavage, for example by gel electrophoresis, northern blot analysis, or RNAse protection assays, to determine the most suitable target site(s) within the target RNA sequence. The target RNA sequence can be obtained as is known in the art, for example, by cloning and/or transcription for in vitro systems, and by cellular expression in in vivo systems.

In one embodiment, the invention features a method comprising: (a) generating a randomized library of siNA constructs having a predetermined complexity, such as of $4^N$, where N represents the number of base paired nucleotides in each of the siNA construct strands (eg. for a siNA construct having 21 nucleotide sense and antisense strands with 19 base pairs, the complexity would be $4^{19}$); and (b) assaying the siNA constructs of (a) above, under conditions suitable to determine RNAi target sites within the target RNA sequence. In another embodiment, the siNA molecules of (a) have strands of a fixed length, for example about 23 nucleotides in length. In yet another embodiment, the siNA molecules of (a) are of differing length, for example having strands of about 15 to about 30 (e.g., about 15, 16, 17, 18, 19, 20, 21, 22, 23, 24, 25, 26, 27, 28, 29, or 30) nucleotides in length. In one embodiment, the assay can comprise a reconstituted in vitro siNA assay as described in Example 6 herein. In another embodiment, the assay can comprise a cell culture system in which target RNA is expressed. In another embodiment, fragments of target RNA are analyzed for detectable levels of cleavage, for example, by gel electrophoresis, northern blot analysis, or RNAse protection assays, to determine the most suitable target site(s) within the target RNA sequence. The target RNA sequence can be obtained as is known in the art, for example, by cloning and/or transcription for in vitro systems, and by cellular expression in in vivo systems.

In another embodiment, the invention features a method comprising: (a) analyzing the sequence of a RNA target encoded by a target gene; (b) synthesizing one or more sets of siNA molecules having sequence complementary to one or more regions of the RNA of (a); and (c) assaying the siNA molecules of (b) under conditions suitable to determine RNAi targets within the target RNA sequence. In one embodiment, the siNA molecules of (b) have strands of a fixed length, for example about 23 nucleotides in length. In another embodiment, the siNA molecules of (b) are of differing length, for example having strands of about 15 to about 30 (e.g., about 15, 16, 17, 18, 19, 20, 21, 22, 23, 24, 25, 26, 27, 28, 29, or 30) nucleotides in length. In one embodiment, the assay can comprise a reconstituted in vitro siNA assay as described herein. In another embodiment, the assay can comprise a cell culture system in which target RNA is expressed. Fragments of target RNA are analyzed for detectable levels of cleavage, for example by gel electrophoresis, northern blot analysis, or RNAse protection assays, to determine the most suitable target site(s) within the target RNA sequence. The target RNA sequence can be obtained as is known in the art, for example, by cloning and/or transcription for in vitro systems, and by expression in in vivo systems.

By "target site" is meant a sequence within a target RNA that is "targeted" for cleavage mediated by a siNA construct which contains sequences within its antisense region that are complementary to the target sequence.

By "detectable level of cleavage" is meant cleavage of target RNA (and formation of cleaved product RNAs) to an extent sufficient to discern cleavage products above the background of RNAs produced by random degradation of the target RNA. Production of cleavage products from 1-5% of the target RNA is sufficient to detect above the background for most methods of detection.

In one embodiment, the invention features a composition comprising a siNA molecule of the invention, which can be chemically-modified, in a pharmaceutically acceptable carrier or diluent. In another embodiment, the invention features a pharmaceutical composition comprising siNA molecules of the invention, which can be chemically-modified, targeting one or more genes in a pharmaceutically acceptable carrier or diluent. In another embodiment, the invention features a method for diagnosing a disease, trait, or condition in a subject comprising administering to the subject a composition of the invention under conditions suitable for the diagnosis of the disease, trait, or condition in the subject. In another embodiment, the invention features a method for treating or preventing a disease, trait, or condition, comprising administering to the subject a composition of the invention under conditions suitable for the treatment or prevention of the disease, trait, or condition in the subject, alone or in conjunction with one or more other therapeutic compounds.

In another embodiment, the invention features a method for validating a target gene target, comprising: (a) synthesizing a siNA molecule of the invention, which can be chemically-modified, wherein one of the siNA strands includes a sequence complementary to RNA of a target gene; (b) introducing the siNA molecule into a cell, tissue, subject, or organism under conditions suitable for modulating expression of the target gene in the cell, tissue, subject, or organism; and (c) determining the function of the gene by assaying for any phenotypic change in the cell, tissue, subject, or organism.

In another embodiment, the invention features a method for validating a target comprising: (a) synthesizing a siNA molecule of the invention, which can be chemically-modified, wherein one of the siNA strands includes a sequence complementary to RNA of a target gene; (b) introducing the siNA molecule into a biological system under conditions suitable for modulating expression of the target gene in the biological system; and (c) determining the function of the gene by assaying for any phenotypic change in the biological system.

By "biological system" is meant, material, in a purified or unpurified form, from biological sources, including but not limited to human or animal, wherein the system comprises the components required for RNAi activity. The term "biological system" includes, for example, a cell, tissue, subject, or organism, or extract thereof. The term biological system also includes reconstituted RNAi systems that can be used in an in vitro setting.

By "phenotypic change" is meant any detectable change to a cell that occurs in response to contact or treatment with a nucleic acid molecule of the invention (e.g., siNA). Such detectable changes include, but are not limited to, changes in shape, size, proliferation, motility, protein expression or RNA expression or other physical or chemical changes as can be assayed by methods known in the art. The detectable change can also include expression of reporter genes/molecules such as Green Florescent Protein (GFP) or various tags that are used to identify an expressed protein or any other cellular component that can be assayed.

In one embodiment, the invention features a kit containing a siNA molecule of the invention, which can be chemically-modified, that can be used to modulate the expression of a target gene in a biological system, including, for example, in a cell, tissue, subject, or organism. In another embodiment, the invention features a kit containing more than one siNA molecule of the invention, which can be chemically-modified, that can be used to modulate the expression of more than one target gene in a biological system, including, for example, in a cell, tissue, subject, or organism.

In one embodiment, the invention features a cell containing one or more siNA molecules of the invention, which can be chemically-modified. In another embodiment, the cell containing a siNA molecule of the invention is a mammalian cell. In yet another embodiment, the cell containing a siNA molecule of the invention is a human cell.

In one embodiment, the synthesis of a siNA molecule of the invention, which can be chemically-modified, comprises: (a) synthesis of two complementary strands of the siNA molecule; (b) annealing the two complementary strands together under conditions suitable to obtain a double-stranded siNA molecule. In another embodiment, synthesis of the two complementary strands of the siNA molecule is by solid phase oligonucleotide synthesis. In yet another embodiment, synthesis of the two complementary strands of the siNA molecule is by solid phase tandem oligonucleotide synthesis.

In one embodiment, the invention features a method for synthesizing a siNA duplex molecule comprising: (a) synthesizing a first oligonucleotide sequence strand of the siNA molecule, wherein the first oligonucleotide sequence strand comprises a cleavable linker molecule that can be used as a scaffold for the synthesis of the second oligonucleotide sequence strand of the siNA; (b) synthesizing the second oligonucleotide sequence strand of siNA on the scaffold of the first oligonucleotide sequence strand, wherein the second oligonucleotide sequence strand further comprises a chemical moiety than can be used to purify the siNA duplex; (c) cleaving the linker molecule of (a) under conditions suitable for the two siNA oligonucleotide strands to hybridize and form a stable duplex; and (d) purifying the siNA duplex utilizing the chemical moiety of the second oligonucleotide sequence strand. In one embodiment, cleavage of the linker molecule in (c) above takes place during deprotection of the oligonucleotide, for example, under hydrolysis conditions using an alkylamine base such as methylamine. In one embodiment, the method of synthesis comprises solid phase synthesis on a solid support such as controlled pore glass (CPG) or polystyrene, wherein the first sequence of (a) is synthesized on a cleavable linker, such as a succinyl linker, using the solid support as a scaffold. The cleavable linker in (a) used as a scaffold for synthesizing the second strand can comprise similar reactivity as the solid support derivatized linker, such that cleavage of the solid support derivatized linker and the cleavable linker of (a) takes place concomitantly. In another embodiment, the chemical moiety of (b) that can be used to isolate the attached oligonucleotide sequence comprises a trityl group, for example a dimethoxytrityl group, which can be employed in a trityl-on synthesis strategy as described herein. In yet another embodiment, the chemical moiety, such as a dimethoxytrityl group, is removed during purification, for example, using acidic conditions.

In a further embodiment, the method for siNA synthesis is a solution phase synthesis or hybrid phase synthesis wherein both strands of the siNA duplex are synthesized in tandem using a cleavable linker attached to the first sequence which acts a scaffold for synthesis of the second sequence. Cleavage of the linker under conditions suitable for hybridization of the separate siNA sequence strands results in formation of the double-stranded siNA molecule.

In another embodiment, the invention features a method for synthesizing a siNA duplex molecule comprising: (a) synthesizing one oligonucleotide sequence strand of the siNA molecule, wherein the sequence comprises a cleavable linker molecule that can be used as a scaffold for the synthesis of another oligonucleotide sequence; (b) synthesizing a second oligonucleotide sequence having complementarity to the first sequence strand on the scaffold of (a), wherein the second sequence comprises the other strand of the double-stranded siNA molecule and wherein the second sequence further comprises a chemical moiety than can be used to isolate the attached oligonucleotide sequence; (c) purifying the product of (b) utilizing the chemical moiety of the second oligonucleotide sequence strand under conditions suitable for isolating the full-length sequence comprising both siNA oligonucleotide strands connected by the cleavable linker and under conditions suitable for the two siNA oligonucleotide strands to hybridize and form a stable duplex. In one embodiment, cleavage of the linker molecule in (c) above takes place during deprotection of the oligonucleotide, for example, under hydrolysis conditions. In another embodiment, cleavage of the linker molecule in (c) above takes place after deprotection of the oligonucleotide. In another embodiment, the method of synthesis comprises solid phase synthesis on a solid support such as controlled pore glass (CPG) or polystyrene, wherein the first sequence of (a) is synthesized on a cleavable linker, such as a succinyl linker, using the solid support as a scaffold. The cleavable linker in (a) used as a scaffold for synthesizing the second strand can comprise similar reactivity or differing reactivity as the solid support derivatized linker, such that cleavage of the solid support derivatized linker and the cleavable linker of (a) takes place either concomitantly or sequentially. In one embodiment, the chemical moiety of (b) that can be used to isolate the attached oligonucleotide sequence comprises a trityl group, for example a dimethoxytrityl group.

In another embodiment, the invention features a method for making a double-stranded siNA molecule in a single synthetic process comprising: (a) synthesizing an oligonucleotide having a first and a second sequence, wherein the first sequence is complementary to the second sequence, and the first oligonucleotide sequence is linked to the second sequence via a cleavable linker, and wherein a terminal 5'-protecting group, for example, a 5'-O-dimethoxytrityl group (5'-O-DMT) remains on the oligonucleotide having the second sequence; (b) deprotecting the oligonucleotide whereby the deprotection results in the cleavage of the linker joining the two oligonucleotide sequences; and (c) purifying the product of (b) under conditions suitable for isolating the double-stranded siNA molecule, for example using a trityl-on synthesis strategy as described herein.

In another embodiment, the method of synthesis of siNA molecules of the invention comprises the teachings of Scaringe et al., U.S. Pat. Nos. 5,889,136; 6,008,400; and 6,111,086, incorporated by reference herein in their entirety.

In one embodiment, the invention features siNA constructs that mediate RNAi against a target polynucleotide (e.g., RNA or DNA target), wherein the siNA construct comprises one or more chemical modifications, for example, one or more chemical modifications having any of Formulae I-VII or any combination thereof that increases the nuclease resistance of the siNA construct.

In another embodiment, the invention features a method for generating siNA molecules with increased nuclease resistance comprising (a) introducing nucleotides having any of Formula I-VII or any combination thereof into a siNA molecule, and (b) assaying the siNA molecule of step (a) under conditions suitable for isolating siNA molecules having increased nuclease resistance.

In another embodiment, the invention features a method for generating siNA molecules with improved toxicologic profiles (e.g., having attenuated or no immunstimulatory properties) comprising (a) introducing nucleotides having any of Formula I-VII (e.g., siNA motifs referred to in Table IV) or any combination thereof into a siNA molecule, and (b) assaying the siNA molecule of step (a) under conditions suitable for isolating siNA molecules having improved toxicologic profiles.

In another embodiment, the invention features a method for generating siNA formulations with improved toxicologic profiles (e.g., having attenuated or no immunstimulatory properties) comprising (a) generating a siNA formulation comprising a siNA molecule of the invention and a delivery vehicle or delivery particle as described herein or as otherwise known in the art, and (b) assaying the siNA formulation of step (a) under conditions suitable for isolating siNA formulations having improved toxicologic profiles.

In another embodiment, the invention features a method for generating siNA molecules that do not stimulate an interferon response (e.g., no interferon response or attenuated interferon response) in a cell, subject, or organism, comprising (a) introducing nucleotides having any of Formula I-VII (e.g., siNA motifs referred to in Table IV) or any combination thereof into a siNA molecule, and (b) assaying the siNA molecule of step (a) under conditions suitable for isolating siNA molecules that do not stimulate an interferon response.

In another embodiment, the invention features a method for generating siNA formulations that do not stimulate an interferon response (e.g., no interferon response or attenuated interferon response) in a cell, subject, or organism, comprising (a) generating a siNA formulation comprising a siNA molecule of the invention and a delivery vehicle or delivery particle as described herein or as otherwise known in the art, and (b) assaying the siNA formulation of step (a) under conditions suitable for isolating siNA formulations that do not stimulate an interferon response. In one embodiment, the interferon comprises interferon alpha.

In another embodiment, the invention features a method for generating siNA molecules that do not stimulate an inflammatory or proinflammatory cytokine response (e.g., no cytokine response or attenuated cytokine response) in a cell, subject, or organism, comprising (a) introducing nucleotides having any of Formula I-VII (e.g., siNA motifs referred to in Table IV) or any combination thereof into a siNA molecule, and (b) assaying the siNA molecule of step (a) under conditions suitable for isolating siNA molecules that do not stimulate a cytokine response. In one embodiment, the cytokine comprises an interleukin such as interleukin-6 (IL-6) and/or tumor necrosis alpha (TNF-α).

In another embodiment, the invention features a method for generating siNA formulations that do not stimulate an inflammatory or proinflammatory cytokine response (e.g., no cytokine response or attenuated cytokine response) in a cell, subject, or organism, comprising (a) generating a siNA formulation comprising a siNA molecule of the invention and a delivery vehicle or delivery particle as described herein or as otherwise known in the art, and (b) assaying the siNA formulation of step (a) under conditions suitable for isolating siNA formulations that do not stimulate a cytokine response. In one embodiment, the cytokine comprises an interleukin such as interleukin-6 (IL-6) and/or tumor necrosis alpha (TNF-α).

In another embodiment, the invention features a method for generating siNA molecules that do not stimulate Toll-like Receptor (TLR) response (e.g., no TLR response or attenuated TLR response) in a cell, subject, or organism, comprising (a) introducing nucleotides having any of Formula I-VII (e.g., siNA motifs referred to in Table IV) or any combination thereof into a siNA molecule, and (b) assaying the siNA molecule of step (a) under conditions suitable for isolating siNA molecules that do not stimulate a TLR response. In one embodiment, the TLR comprises TLR3, TLR7, TLR8 and/or TLR9.

In one embodiment, a chemically modified siNA molecule of the invention has an improved toxicologic profile compared to a corresponding siRNA molecule having no chemical modifications or fewer chemical modifications.

In another embodiment, the invention features a method for generating siNA formulations that do not stimulate a Toll-like Receptor (TLR) response (e.g., no TLR response or attenuated TLR response) in a cell, subject, or organism, comprising (a) generating a siNA formulation comprising a siNA molecule of the invention and a delivery vehicle or delivery particle as described herein or as otherwise known in the art, and (b) assaying the siNA formulation of step (a) under conditions suitable for isolating siNA formulations that do not stimulate a TLR response. In one embodiment, the TLR comprises TLR3, TLR7, TLR8 and/or TLR9.

In one embodiment, the invention features a chemically synthesized double stranded short interfering nucleic acid (siNA) molecule that directs cleavage of a target RNA via RNA interference (RNAi), wherein: (a) each strand of said siNA molecule is about 18 to about 38 nucleotides in length; (b) one strand of said siNA molecule comprises nucleotide sequence having sufficient complementarity to said target RNA for the siNA molecule to direct cleavage of the target RNA via RNA interference; and (c) wherein the nucleotide positions within said siNA molecule are chemically modified to reduce the immunostimulatory properties of the siNA molecule to a level below that of a corresponding unmodified siRNA molecule. Such siNA molecules are said to have an improved toxicologic profile compared to an unmodified or minimally modified siNA.

By "improved toxicologic profile", is meant that the chemically modified or formulated siNA construct exhibits decreased toxicity in a cell, subject, or organism compared to an unmodified or unformulated siNA, or siNA molecule having fewer modifications or modifications that are less effective in imparting improved toxicology. Such siNA molecules are also considered to have "improved RNAi activity". In a non-limiting example, siNA molecules and formulations with improved toxicologic profiles are associated with reduced immunostimulatory properties, such as a reduced, decreased or attenuated immunostimulatory response in a cell, subject, or organism compared to an unmodified or unformulated siNA, or siNA molecule having fewer modifications or modifications that are less effective in imparting improved toxicology. Such an improved toxicologic profile is characterized by abrogated or reduced immunostimulation, such as reduction or abrogation of induction of interferons (e.g., interferon alpha), inflammatory cytokines (e.g., interleukins such as IL-6, and/or TNF-alpha), and/or toll like receptors (e.g., TLR-3, TLR-7, TLR-8, and/or TLR-9). In one embodiment, a siNA molecule or formulation with an improved toxicological profile comprises no ribonucleotides. In one embodiment, a siNA molecule or formulation with an improved toxicological profile comprises less than 5 ribonucleotides (e.g., 1, 2, 3, or 4 ribonucleotides). In one embodiment, a siNA molecule or formulation with an improved toxicological profile comprises Stab 7, Stab 8, Stab 11, Stab 12, Stab 13, Stab 16, Stab 17, Stab 18, Stab 19, Stab 20, Stab 23, Stab 24, Stab 25, Stab 26, Stab 27, Stab 28, Stab 29, Stab 30, Stab 31, Stab 32, Stab 33, Stab 34, Stab 35, Stab 36 or any combination thereof (see Table IV). Herein, numeric Stab chemistries include both 2'-fluoro and 2'-OCF$_3$ versions of the chemistries shown in Table IV. For example, "Stab 7/8" refers to both Stab 7/8 and Stab 7F/8F etc. In one embodiment, a siNA molecule or formulation with an improved toxicological profile comprises a siNA molecule of the invention and a formulation as described in United States Patent Application Publication No. 20030077829, incorporated by reference herein in its entirety including the drawings.

In one embodiment, the level of immunostimulatory response associated with a given siNA molecule can be measured as is described herein or as is otherwise known in the art, for example by determining the level of PKR/interferon response, proliferation, B-cell activation, and/or cytokine production in assays to quantitate the immunostimulatory response of particular siNA molecules (see, for example, Leifer et al., 2003, *J. Immunother.* 26, 313-9; and U.S. Pat. No. 5,968,909, incorporated in its entirety by reference). In one embodiment, the reduced immunostimulatory response is between about 10% and about 100% compared to an unmodified or minimally modified siRNA molecule, e.g., about 10%, 20%, 30%, 40%, 50%, 60%, 70%, 80%, 90% or 100% reduced immunostimulatory response.

In one embodiment, the immunostimulatory response associated with a siNA molecule can be modulated by the degree of chemical modification. For example, a siNA molecule having between about 10% and about 100%, (e.g., about 10%, 20%, 30%, 40%, 50%, 60%, 70%, 80%, 90% or 100% or at least about 10%, 20%, 30%, 40%, 50%, 60%, 70%, 80%, 90% or 100%) of the nucleotide positions in the siNA molecule modified can be selected to have a corresponding degree of immunostimulatory properties as described herein.

In one embodiment, the degree of reduced immunostimulatory response is selected for optimized RNAi activity. For example, retaining a certain degree of immunostimulation can be preferred to treat viral infection, where less than 100% reduction in immunostimulation may be preferred for maximal antiviral activity (e.g., about 10%, 20%, 30%, 40%, 50%, 60%, 70%, 80%, or 90% reduction in immunostimulation) whereas the inhibition of expression of an endogenous gene target may be preferred with siNA molecules that poses minimal immunostimulatory properties to prevent non-specific toxicity or off target effects (e.g., about 90% to about 100% reduction in immunostimulation).

In one embodiment, the invention features a chemically synthesized double stranded siNA molecule that directs cleavage of a target RNA via RNA interference (RNAi), wherein (a) each strand of said siNA molecule is about 18 to about 38 nucleotides in length; (b) one strand of said siNA molecule comprises nucleotide sequence having sufficient complementarity to said target RNA for the siNA molecule to direct cleavage of the target RNA via RNA interference; and (c) wherein one or more nucleotides of said siNA molecule are chemically modified to reduce the immunostimulatory properties of the siNA molecule to a level below that of a corresponding unmodified siNA molecule. In one embodiment, each strand comprises at least about 18 nucleotides that are complementary to the nucleotides of the other strand.

In another embodiment, the siNA molecule comprising modified nucleotides to reduce the immunostimulatory properties of the siNA molecule comprises an antisense region having nucleotide sequence that is complementary to a nucleotide sequence of a target gene or a portion thereof and further comprises a sense region, wherein said sense region comprises a nucleotide sequence substantially similar to the nucleotide sequence of said target gene or portion thereof. In one embodiment thereof, the antisense region and the sense region comprise about 18 to about 38 nucleotides, wherein said antisense region comprises at least about 18 nucleotides that are complementary to nucleotides of the sense region. In one embodiment thereof, the pyrimidine nucleotides in the sense region are 2'-O-methyl pyrimidine nucleotides. In another embodiment thereof, the purine nucleotides in the sense region are 2'-deoxy purine nucleotides. In yet another embodiment thereof, the pyrimidine nucleotides present in the sense region are 2'-deoxy-2'-fluoro pyrimidine nucleotides. In another embodiment thereof, the pyrimidine nucleotides of said antisense region are 2'-deoxy-2'-fluoro pyrimidine nucleotides. In yet another embodiment thereof, the purine nucleotides of said antisense region are 2'-O-methyl purine nucleotides. In still another embodiment thereof, the purine nucleotides present in said antisense region comprise 2'-deoxypurine nucleotides. In another embodiment, the antisense region comprises a phosphorothioate internucleotide linkage at the 3' end of said antisense region. In another embodiment, the antisense region comprises a glyceryl modification at a 3' end of said antisense region.

In other embodiments, the siNA molecule comprising modified nucleotides to reduce the immunostimulatory properties of the siNA molecule can comprise any of the structural features of siNA molecules described herein. In other embodiments, the siNA molecule comprising modified nucleotides to reduce the immunostimulatory properties of the siNA molecule can comprise any of the chemical modifications of siNA molecules described herein.

In one embodiment, the invention features a method for generating a chemically synthesized double stranded siNA molecule having chemically modified nucleotides to reduce the immunostimulatory properties of the siNA molecule, comprising (a) introducing one or more modified nucleotides in the siNA molecule, and (b) assaying the siNA molecule of step (a) under conditions suitable for isolating an siNA molecule having reduced immunostimulatory properties compared to a corresponding siNA molecule having unmodified nucleotides. Each strand of the siNA molecule is about 18 to about 38 nucleotides in length. One strand of the siNA molecule comprises nucleotide sequence having sufficient complementarity to the target RNA for the siNA molecule to direct cleavage of the target RNA via RNA interference. In one embodiment, the reduced immunostimulatory properties comprise an abrogated or reduced induction of inflammatory or proinflammatory cytokines, such as interleukin-6 (IL-6) or tumor necrosis alpha (TNF-α), in response to the siNA being introduced in a cell, tissue, or organism. In another embodiment, the reduced immunostimulatory properties comprise an abrogated or reduced induction of Toll Like Receptors (TLRs), such as TLR3, TLR7, TLR8 or TLR9, in response to the siNA being introduced in a cell, tissue, or organism. In another embodiment, the reduced immunostimulatory properties comprise an abrogated or reduced induction of interferons, such as interferon alpha, in response to the siNA being introduced in a cell, tissue, or organism.

In one embodiment, the invention features siNA constructs that mediate RNAi against a target polynucleotide, wherein the siNA construct comprises one or more chemical modifications described herein that modulates the binding affinity between the sense and antisense strands of the siNA construct.

In another embodiment, the invention features a method for generating siNA molecules with increased binding affinity between the sense and antisense strands of the siNA molecule comprising (a) introducing nucleotides having any of Formula I-VII or any combination thereof into a siNA molecule, and (b) assaying the siNA molecule of step (a) under conditions suitable for isolating siNA molecules having increased binding affinity between the sense and antisense strands of the siNA molecule.

In one embodiment, the invention features siNA constructs that mediate RNAi against a target polynucleotide, wherein the siNA construct comprises one or more chemical modifications described herein that modulates the binding affinity between the antisense strand of the siNA construct and a complementary target RNA sequence within a cell.

In one embodiment, the invention features siNA constructs that mediate RNAi against a target polynucleotide, wherein the siNA construct comprises one or more chemical modifications described herein that modulates the binding affinity between the antisense strand of the siNA construct and a complementary target DNA sequence within a cell.

In another embodiment, the invention features a method for generating siNA molecules with increased binding affinity between the antisense strand of the siNA molecule and a complementary target RNA sequence comprising (a) introducing nucleotides having any of Formula I-VII or any combination thereof into a siNA molecule, and (b) assaying the siNA molecule of step (a) under conditions suitable for isolating siNA molecules having increased binding affinity between the antisense strand of the siNA molecule and a complementary target RNA sequence.

In another embodiment, the invention features a method for generating siNA molecules with increased binding affinity between the antisense strand of the siNA molecule and a complementary target DNA sequence comprising (a) introducing nucleotides having any of Formula I-VII or any combination thereof into a siNA molecule, and (b) assaying the siNA molecule of step (a) under conditions suitable for isolating siNA molecules having increased binding affinity between the antisense strand of the siNA molecule and a complementary target DNA sequence.

In one embodiment, the invention features siNA constructs that mediate RNAi against a target polynucleotide, wherein the siNA construct comprises one or more chemical modifications described herein that modulate the polymerase activity of a cellular polymerase capable of generating additional endogenous siNA molecules having sequence homology to the chemically-modified siNA construct.

In another embodiment, the invention features a method for generating siNA molecules capable of mediating increased polymerase activity of a cellular polymerase capable of generating additional endogenous siNA molecules having sequence homology to a chemically-modified siNA molecule comprising (a) introducing nucleotides having any of Formula I-VII or any combination thereof into a siNA molecule, and (b) assaying the siNA molecule of step (a) under conditions suitable for isolating siNA molecules capable of mediating increased polymerase activity of a cellular polymerase capable of generating additional endogenous siNA molecules having sequence homology to the chemically-modified siNA molecule.

In one embodiment, the invention features chemically-modified siNA constructs that mediate RNAi against a target polynucleotide in a cell, wherein the chemical modifications do not significantly effect the interaction of siNA with a target RNA molecule, DNA molecule and/or proteins or other factors that are essential for RNAi in a manner that would decrease the efficacy of RNAi mediated by such siNA constructs.

In another embodiment, the invention features a method for generating siNA molecules with improved RNAi specificity against polynucleotide targets comprising (a) introducing nucleotides having any of Formula I-VII or any combination thereof into a siNA molecule, and (b) assaying the siNA molecule of step (a) under conditions suitable for isolating siNA molecules having improved RNAi specificity. In one embodiment, improved specificity comprises having reduced off target effects compared to an unmodified siNA molecule. For example, introduction of terminal cap moieties at the 3'-end, 5'-end, or both 3' and 5'-ends of the sense strand or region of a siNA molecule of the invention can direct the siNA to have improved specificity by preventing the sense strand or sense region from acting as a template for RNAi activity against a corresponding target having complementarity to the sense strand or sense region.

In another embodiment, the invention features a method for generating siNA molecules with improved RNAi activity against a target polynucleotide comprising (a) introducing nucleotides having any of Formula I-VII or any combination thereof into a siNA molecule, and (b) assaying the siNA molecule of step (a) under conditions suitable for isolating siNA molecules having improved RNAi activity.

In yet another embodiment, the invention features a method for generating siNA molecules with improved RNAi activity against a target RNA comprising (a) introducing nucleotides having any of Formula I-VII or any combination thereof into a siNA molecule, and (b) assaying the siNA molecule of step (a) under conditions suitable for isolating siNA molecules having improved RNAi activity against the target RNA.

In yet another embodiment, the invention features a method for generating siNA molecules with improved RNAi activity against a target DNA comprising (a) introducing nucleotides having any of Formula I-VII or any combination thereof into a siNA molecule, and (b) assaying the siNA molecule of step (a) under conditions suitable for isolating siNA molecules having improved RNAi activity against the target DNA.

In one embodiment, the invention features siNA constructs that mediate RNAi against a target polynucleotide, wherein the siNA construct comprises one or more chemical modifications described herein that modulates the cellular uptake of the siNA construct, such as cholesterol conjugation of the siNA.

In another embodiment, the invention features a method for generating siNA molecules against a target polynucleotide with improved cellular uptake comprising (a) introducing nucleotides having any of Formula I-VII or any combination thereof into a siNA molecule, and (b) assaying the siNA molecule of step (a) under conditions suitable for isolating siNA molecules having improved cellular uptake.

In one embodiment, the invention features siNA constructs that mediate RNAi against a target polynucleotide, wherein the siNA construct comprises one or more chemical modifications described herein that increases the bioavailability of the siNA construct, for example, by attaching polymeric conjugates such as polyethyleneglycol or equivalent conjugates that improve the pharmacokinetics of the siNA construct, or by attaching conjugates that target specific tissue types or cell types in vivo. Non-limiting examples of such conjugates are described in Vargeese et al., U.S. Ser. No. 10/201,394 incorporated by reference herein.

In one embodiment, the invention features a method for generating siNA molecules of the invention with improved bioavailability comprising (a) introducing a conjugate into the structure of a siNA molecule, and (b) assaying the siNA molecule of step (a) under conditions suitable for isolating siNA molecules having improved bioavailability. Such conjugates can include ligands for cellular receptors, such as peptides derived from naturally occurring protein ligands; protein localization sequences, including cellular ZIP code sequences; antibodies; nucleic acid aptamers; vitamins and other co-factors, such as folate and N-acetylgalactosamine; polymers, such as polyethyleneglycol (PEG); phospholipids; cholesterol; cholesterol derivatives, polyamines, such as spermine or spermidine; and others.

In one embodiment, the invention features a double stranded short interfering nucleic acid (siNA) molecule that comprises a first nucleotide sequence complementary to a target RNA sequence or a portion thereof, and a second sequence having complementarity to said first sequence, wherein said second sequence is chemically modified in a manner that it can no longer act as a guide sequence for efficiently mediating RNA interference and/or be recognized by cellular proteins that facilitate RNAi. In one embodiment, the first nucleotide sequence of the siNA is chemically modified as described herein. In one embodiment, the first nucleotide sequence of the siNA is not modified (e.g., is all RNA).

In one embodiment, the invention features a double stranded short interfering nucleic acid (siNA) molecule that comprises a first nucleotide sequence complementary to a target RNA sequence or a portion thereof, and a second sequence having complementarity to said first sequence, wherein the second sequence is designed or modified in a manner that prevents its entry into the RNAi pathway as a guide sequence or as a sequence that is complementary to a target nucleic acid (e.g., RNA) sequence. In one embodiment, the first nucleotide sequence of the siNA is chemically modified as described herein. In one embodiment, the first nucleotide sequence of the siNA is not modified (e.g., is all RNA). Such design or modifications are expected to enhance the activity of siNA and/or improve the specificity of siNA molecules of the invention. These modifications are also expected to minimize any off-target effects and/or associated toxicity.

In one embodiment, the invention features a double stranded short interfering nucleic acid (siNA) molecule that comprises a first nucleotide sequence complementary to a target RNA sequence or a portion thereof, and a second sequence having complementarity to said first sequence, wherein said second sequence is incapable of acting as a guide sequence for mediating RNA interference. In one embodiment, the first nucleotide sequence of the siNA is chemically modified as described herein. In one embodiment, the first nucleotide sequence of the siNA is not modified (e.g., is all RNA).

In one embodiment, the invention features a double stranded short interfering nucleic acid (siNA) molecule that comprises a first nucleotide sequence complementary to a target RNA sequence or a portion thereof, and a second sequence having complementarity to said first sequence, wherein said second sequence does not have a terminal 5'-hydroxyl (5'-OH) or 5'-phosphate group.

In one embodiment, the invention features a double stranded short interfering nucleic acid (siNA) molecule that comprises a first nucleotide sequence complementary to a target RNA sequence or a portion thereof, and a second sequence having complementarity to said first sequence, wherein said second sequence comprises a terminal cap moiety at the 5'-end of said second sequence. In one embodiment, the terminal cap moiety comprises an inverted abasic, inverted deoxy abasic, inverted nucleotide moiety, a group shown in FIG. 10, an alkyl or cycloalkyl group, a heterocycle, or any other group that prevents RNAi activity in which the second sequence serves as a guide sequence or template for RNAi.

In one embodiment, the invention features a double stranded short interfering nucleic acid (siNA) molecule that comprises a first nucleotide sequence complementary to a target RNA sequence or a portion thereof, and a second sequence having complementarity to said first sequence, wherein said second sequence comprises a terminal cap moiety at the 5'-end and 3'-end of said second sequence. In one embodiment, each terminal cap moiety individually comprises an inverted abasic, inverted deoxy abasic, inverted nucleotide moiety, a group shown in FIG. 10, an alkyl or cycloalkyl group, a heterocycle, or any other group that prevents RNAi activity in which the second sequence serves as a guide sequence or template for RNAi.

In one embodiment, the invention features a method for generating siNA molecules of the invention with improved specificity for down regulating or inhibiting the expression of a target nucleic acid (e.g., a DNA or RNA such as a gene or its corresponding RNA), comprising (a) introducing one or more chemical modifications into the structure of a siNA molecule, and (b) assaying the siNA molecule of step (a) under conditions suitable for isolating siNA molecules having improved specificity. In another embodiment, the chemical modification used to improve specificity comprises terminal cap modifications at the 5'-end, 3'-end, or both 5' and 3'-ends of the siNA molecule. The terminal cap modifications can comprise, for example, structures shown in FIG. 10 (e.g. inverted deoxyabasic moieties) or any other chemical modification that renders a portion of the siNA molecule (e.g. the sense strand) incapable of mediating RNA interference against an off target nucleic acid sequence. In a non-limiting example, a siNA molecule is designed such that only the antisense sequence of the siNA molecule can serve as a guide sequence for RISC mediated degradation of a corresponding target RNA sequence. This can be accomplished by rendering the sense sequence of the siNA inactive by introducing chemical modifications to the sense strand that preclude recognition of the sense strand as a guide sequence by RNAi machinery. In one embodiment, such chemical modifications comprise any chemical group at the 5'-end of the sense strand of the siNA, or any other group that serves to render the sense strand inactive as a guide sequence for mediating RNA interference. These modifications, for example, can result in a molecule where the 5'-end of the sense strand no longer has a free 5'-hydroxyl (5'-OH) or a free 5'-phosphate group (e.g., phosphate, diphosphate, triphosphate, cyclic phosphate etc.). Non-limiting examples of such siNA constructs are described herein, such as "Stab 9/10", "Stab 7/8", "Stab 7/19", "Stab 17/22", "Stab 23/24", "Stab 24/25", and "Stab 24/26" (e.g., any siNA having Stab 7, 9, 17, 23, or 24 sense strands) chemistries and variants thereof (see Table IV) wherein the 5'-end and 3'-end of the sense strand of the siNA do not comprise a hydroxyl group or phosphate group. Herein, numeric Stab chemistries include both 2'-fluoro and 2'-OCF$_3$ versions of the chemistries shown in Table IV. For example, "Stab 7/8" refers to both Stab 7/8 and Stab 7F/8F etc.

In one embodiment, the invention features a method for generating siNA molecules of the invention with improved specificity for down regulating or inhibiting the expression of a target nucleic acid (e.g., a DNA or RNA such as a gene or its corresponding RNA), comprising introducing one or more chemical modifications into the structure of a siNA molecule that prevent a strand or portion of the siNA molecule from acting as a template or guide sequence for RNAi activity. In one embodiment, the inactive strand or sense region of the siNA molecule is the sense strand or sense region of the siNA molecule, i.e. the strand or region of the siNA that does not have complementarity to the target nucleic acid sequence. In one embodiment, such chemical modifications comprise any chemical group at the 5'-end of the sense strand or region of the siNA that does not comprise a 5'-hydroxyl (5'-OH) or 5'-phosphate group, or any other group that serves to render the sense strand or sense region inactive as a guide sequence for mediating RNA interference. Non-limiting examples of such siNA constructs are described herein, such as "Stab 9/10", "Stab 7/8", "Stab 7/19", "Stab 17/22", "Stab 23/24", "Stab 24/25", and "Stab 24/26" (e.g., any siNA having Stab 7, 9, 17, 23, or 24 sense strands) chemistries and variants thereof (see Table IV) wherein the 5'-end and 3'-end of the sense strand of the siNA do not comprise a hydroxyl group or phosphate group. Herein, numeric Stab chemistries include both 2'-fluoro and 2'-OCF$_3$ versions of the chemistries shown in Table IV. For example, "Stab 7/8" refers to both Stab 7/8 and Stab 7F/8F etc.

In one embodiment, the invention features a method for screening siNA molecules that are active in mediating RNA interference against a target nucleic acid sequence comprising (a) generating a plurality of unmodified siNA molecules, (b) screening the siNA molecules of step (a) under conditions suitable for isolating siNA molecules that are active in mediating RNA interference against the target nucleic acid sequence, and (c) introducing chemical modifications (e.g. chemical modifications as described herein or as otherwise known in the art) into the active siNA molecules of (b). In one embodiment, the method further comprises re-screening the chemically modified siNA molecules of step (c) under conditions suitable for isolating chemically modified siNA molecules that are active in mediating RNA interference against the target nucleic acid sequence.

In one embodiment, the invention features a method for screening chemically modified siNA molecules that are active in mediating RNA interference against a target nucleic acid sequence comprising (a) generating a plurality of chemically modified siNA molecules (e.g. siNA molecules as described herein or as otherwise known in the art), and (b) screening the siNA molecules of step (a) under conditions suitable for isolating chemically modified siNA molecules that are active in mediating RNA interference against the target nucleic acid sequence.

The term "ligand" refers to any compound or molecule, such as a drug, peptide, hormone, or neurotransmitter, that is capable of interacting with another compound, such as a receptor, either directly or indirectly. The receptor that interacts with a ligand can be present on the surface of a cell or can alternately be an intercellular receptor. Interaction of the ligand with the receptor can result in a biochemical reaction, or can simply be a physical interaction or association.

In another embodiment, the invention features a method for generating siNA molecules of the invention with improved bioavailability comprising (a) introducing an excipient formulation to a siNA molecule, and (b) assaying the siNA molecule of step (a) under conditions suitable for isolating siNA molecules having improved bioavailability. Such excipients include polymers such as cyclodextrins, lipids, cationic lipids, polyamines, phospholipids, nanoparticles, receptors, ligands, and others.

In another embodiment, the invention features a method for generating siNA molecules of the invention with improved bioavailability comprising (a) introducing nucleotides having any of Formulae I-VII or any combination thereof into a siNA molecule, and (b) assaying the siNA molecule of step (a) under conditions suitable for isolating siNA molecules having improved bioavailability.

In another embodiment, polyethylene glycol (PEG) can be covalently attached to siNA compounds of the present invention. The attached PEG can be any molecular weight, preferably from about 100 to about 50,000 daltons (Da).

The present invention can be used alone or as a component of a kit having at least one of the reagents necessary to carry out the in vitro or in vivo introduction of RNA to test samples and/or subjects. For example, preferred components of the kit include a siNA molecule of the invention and a vehicle that promotes introduction of the siNA into cells of interest as described herein (e.g., using lipids and other methods of transfection known in the art, see for example Beigelman et al, U.S. Pat. No. 6,395,713). The kit can be used for target validation, such as in determining gene function and/or activity, or in drug optimization, and in drug discovery (see for example Usman et al., U.S. Ser. No. 60/402,996). Such a kit can also include instructions to allow a user of the kit to practice the invention.

The term "short interfering nucleic acid", "siNA", "short interfering RNA", "siRNA", "short interfering nucleic acid molecule", "short interfering oligonucleotide molecule", or "chemically-modified short interfering nucleic acid molecule" as used herein refers to any nucleic acid molecule capable of inhibiting or down regulating gene expression or viral replication by mediating RNA interference "RNAi" or gene silencing in a sequence-specific manner. These terms can refer to both individual nucleic acid molecules, a plurality of such nucleic acid molecules, or pools of such nucleic acid molecules. The siNA can be a double-stranded nucleic acid molecule comprising self-complementary sense and antisense regions, wherein the antisense region comprises nucleotide sequence that is complementary to nucleotide sequence in a target nucleic acid molecule or a portion thereof and the sense region having nucleotide sequence corresponding to the target nucleic acid sequence or a portion thereof. The siNA can be assembled from two separate oligonucleotides, where one strand is the sense strand and the other is the antisense strand, wherein the antisense and sense strands are self-complementary (i.e., each strand comprises nucleotide sequence that is complementary to nucleotide sequence in the other strand; such as where the antisense strand and sense strand form a duplex or double stranded structure, for example wherein the double stranded region is about 15 to about 30, e.g., about 15, 16, 17, 18, 19, 20, 21, 22, 23, 24, 25, 26, 27, 28, 29 or 30 base pairs; the antisense strand comprises nucleotide sequence that is complementary to nucleotide sequence in a target nucleic acid molecule or a portion thereof and the sense strand comprises nucleotide sequence corresponding to the target nucleic acid sequence or a portion thereof (e.g., about 15 to about 25 or more nucleotides of the siNA molecule are complementary to the target nucleic acid or a portion thereof). Alternatively, the siNA is assembled from a single oligonucleotide, where the self-complementary sense and antisense regions of the siNA are linked by means of a nucleic acid based or non-nucleic acid-based linker(s). The siNA can be a polynucleotide with a duplex, asymmetric duplex, hairpin or asymmetric hairpin secondary structure, having self-complementary sense and antisense regions, wherein the antisense region comprises nucleotide sequence that is complementary to nucleotide sequence in a separate target nucleic acid molecule or a portion thereof and the sense region having nucleotide sequence corresponding to the target nucleic acid sequence or a portion thereof. The siNA can be a circular single-stranded polynucleotide having two or more loop structures and a stem comprising self-complementary sense and antisense regions, wherein the antisense region comprises nucleotide sequence that is complementary to nucleotide sequence in a target nucleic acid molecule or a portion thereof and the sense region having nucleotide sequence corresponding to the target nucleic acid sequence or a portion thereof, and wherein the circular polynucleotide can be processed either in vivo or in vitro to generate an active siNA molecule capable of mediating RNAi. The siNA can also comprise a single stranded polynucleotide having nucleotide sequence complementary to nucleotide sequence in a target nucleic acid molecule or a portion thereof (for example, where such siNA molecule does not require the presence within the siNA molecule of nucleotide sequence corresponding to the target nucleic acid sequence or a portion thereof), wherein the single stranded polynucleotide can further comprise a terminal phosphate group, such as a 5'-phosphate (see for example Martinez et al., 2002, *Cell.,* 110, 563-574 and Schwarz et al., 2002, *Molecular Cell,* 10, 537-568), or 5',3'-diphosphate. In certain embodiments, the siNA molecule of the invention comprises separate sense and antisense sequences or regions, wherein the sense and antisense regions are covalently linked by nucleotide or non-nucleotide linkers molecules as is known in the art, or are alternately non-covalently linked by ionic interactions, hydrogen bonding, van der waals interactions, hydrophobic interactions, and/or stacking interactions. In certain embodiments, the siNA molecules of the invention comprise nucleotide sequence that is complementary to nucleotide sequence of a target gene. In another embodiment, the siNA molecule of the invention interacts with nucleotide sequence of a target gene in a manner that causes inhibition of expression of the target gene. As used herein, siNA molecules need not be limited to those molecules containing only RNA, but further encompasses chemically-modified nucleotides and non-nucleotides. In certain embodiments, the short interfering nucleic acid molecules of the invention lack 2'-hydroxy (2'-OH) containing nucleotides. Applicant describes in certain embodiments short interfering nucleic acids that do not require the presence of nucleotides having a 2'-hydroxy group for mediating RNAi and as such, short interfering nucleic acid molecules of the invention optionally do not include any ribonucleotides (e.g., nucleotides having a 2'-OH group). Such siNA molecules that do not require the presence of ribonucleotides within the siNA molecule to support RNAi can however have an attached linker or linkers or other attached or associated groups, moieties, or chains containing one or more nucleotides with 2'-OH groups. Optionally, siNA molecules can comprise ribonucleotides at about 5, 10, 20, 30, 40, or 50% of the nucleotide positions. The modified short interfering nucleic acid molecules of the invention can also be referred to as short interfering modified oligonucleotides "siMON." As used herein, the term siNA is meant to be equivalent to other terms used to describe nucleic acid molecules that are capable of mediating sequence specific RNAi, for example short interfering RNA (siRNA), double-stranded RNA (dsRNA), micro-RNA (miRNA), short hairpin RNA (shRNA), short interfering oligonucleotide, short interfering nucleic acid, short interfering modified oligonucleotide, chemically-modified siRNA, post-transcriptional gene silencing RNA (ptgsRNA), and others. Non limiting examples of siNA molecules of the invention are shown in FIGS. 4-6, and Tables II and III herein. Such siNA molecules are distinct from other nucleic acid technologies known in the art that mediate inhibition of gene expression, such as ribozymes, antisense, triplex forming, aptamer, 2,5-A chimera, or decoy oligonucleotides.

By "RNA interference" or "RNAi" is meant a biological process of inhibiting or down regulating gene expression in a cell as is generally known in the art and which is mediated by short interfering nucleic acid molecules, see for example Zamore and Haley, 2005, *Science,* 309, 1519-1524; Vaughn and Martienssen, 2005, *Science,* 309, 1525-1526; Zamore et al., 2000, *Cell,* 101, 25-33; Bass, 2001, *Nature,* 411, 428-429; Elbashir et al., 2001, *Nature,* 411, 494-498; and Kreutzer et al., International PCT Publication No. WO 00/44895; Zernicka-Goetz et al., International PCT Publication No. WO 01/36646; Fire, International PCT Publication No. WO 99/32619; Plaetinck et al., International PCT Publication No. WO 00/01846; Mello and Fire, International PCT Publication No. WO 01/29058; Deschamps-Depaillette, International PCT Publication No. WO 99/07409; and Li et al., International PCT Publication No. WO 00/44914; Allshire, 2002, *Science,* 297, 1818-1819; Volpe et al., 2002, *Science,* 297, 1833-1837; Jenuwein, 2002, *Science,* 297, 2215-2218; and Hall et al., 2002, *Science,* 297, 2232-2237; Hutvagner and Zamore, 2002, *Science,* 297, 2056-60; McManus et al., 2002, *RNA,* 8, 842-850; Reinhart et al., 2002, *Gene & Dev.,* 16, 1616-1626; and Reinhart & Bartel, 2002, *Science,* 297, 1831). In addition, as used herein, the term RNAi is meant to be equivalent to other terms used to describe sequence specific RNA interference, such as post transcriptional gene silencing, translational inhibition, transcriptional inhibition, or epigenetics. For example, siNA molecules of the invention can be used to epigenetically silence genes at both the post-transcriptional level or the pre-transcriptional level. In a non-limiting example, epigenetic modulation of gene expression by siNA molecules of the invention can result from siNA mediated modification of chromatin structure or methylation patterns to alter gene expression (see, for example, Verdel et al., 2004, *Science,* 303, 672-676; Pal-Bhadra et al., 2004, *Science,* 303, 669-672; Allshire, 2002, *Science,* 297, 1818-1819; Volpe et al., 2002, *Science,* 297, 1833-1837; Jenuwein, 2002, Science, 297, 2215-2218; and Hall et al., 2002, *Science,* 297, 2232-2237). In another non-limiting example, modulation of gene expression by siNA molecules of the invention can result from siNA mediated cleavage of RNA (either coding or non-coding RNA) via RISC, or alternately, translational inhibition as is known in the art. In another embodiment, modulation of gene expression by siNA molecules of the invention can result from transcriptional inhibition (see for example Janowski et al., 2005, *Nature Chemical Biology,* 1, 216-222).

In one embodiment, a siNA molecule of the invention is a duplex forming oligonucleotide "DFO", (see for example FIGS. 14-15 and Vaish et al., U.S. Ser. No. 10/727,780 filed Dec. 3, 2003 and International PCT Application No. US04/16390, filed May 24, 2004).

In one embodiment, a siNA molecule of the invention is a multifunctional siNA, (see for example FIGS. 16-21 and Jadhav et al., U.S. Ser. No. 60/543,480 filed Feb. 10, 2004 and International PCT Application No. US04/16390, filed May 24, 2004). In one embodiment, the multifunctional siNA of the invention can comprise sequence targeting, for example, two or more regions of target RNA (see for example target sequences in Tables II and III). In one embodiment, the multifunctional siNA of the invention can comprise sequence targeting HCV RNA and one or more cellular targets involved in the HCV lifecycle, such as cellular receptors, cell surface molecules, cellular enzymes, cellular transcription factors, and/or cytokines, second messengers, and cellular accessory molecules including, but not limited to, La antigen (see for example Costa-Mattioli et al., 2004, *Mol Cell Biol.*, 24, 6861-70, e.g., Genbank Accession No. NM_003142) (e.g., interferon regulatory factors (IRFs; e.g., Genbank Accession No. AF082503.1); cellular PKR protein kinase (e.g., Genbank Accession No. XM_002661.7); human eukaryotic initiation factors 2B (elF2Bgamma; e.g., Genbank Accession No. AF256223, and/or elF2gamma; e.g., Genbank Accession No. NM_006874.1); human DEAD Box protein (DDX3; e.g., Genbank Accession No. XM_018021.2); and cellular proteins that bind to the poly(U) tract of the HCV 3'-UTR, such as polypyrimidine tract-binding protein (e.g., Genbank Accession Nos. NM_031991.1 and XM_042972.3).

By "asymmetric hairpin" as used herein is meant a linear siNA molecule comprising an antisense region, a loop portion that can comprise nucleotides or non-nucleotides, and a sense region that comprises fewer nucleotides than the antisense region to the extent that the sense region has enough complementary nucleotides to base pair with the antisense region and form a duplex with loop. For example, an asymmetric hairpin siNA molecule of the invention can comprise an antisense region having length sufficient to mediate RNAi in a cell or in vitro system (e.g. about 15 to about 30, or about 15, 16, 17, 18, 19, 20, 21, 22, 23, 24, 25, 26, 27, 28, 29, or 30 nucleotides) and a loop region comprising about 4 to about 12 (e.g., about 4, 5, 6, 7, 8, 9, 10, 11, or 12) nucleotides, and a sense region having about 3 to about 25 (e.g., about 3, 4, 5, 6, 7, 8, 9, 10, 11, 12, 13, 14, 15, 16, 17, 18, 19, 20, 21, 22, 23, 24, or 25) nucleotides that are complementary to the antisense region. The asymmetric hairpin siNA molecule can also comprise a 5'-terminal phosphate group that can be chemically modified. The loop portion of the asymmetric hairpin siNA molecule can comprise nucleotides, non-nucleotides, linker molecules, or conjugate molecules as described herein.

By "asymmetric duplex" as used herein is meant a siNA molecule having two separate strands comprising a sense region and an antisense region, wherein the sense region comprises fewer nucleotides than the antisense region to the extent that the sense region has enough complementary nucleotides to base pair with the antisense region and form a duplex. For example, an asymmetric duplex siNA molecule of the invention can comprise an antisense region having length sufficient to mediate RNAi in a cell or in vitro system (e.g., about 15 to about 30, or about 15, 16, 17, 18, 19, 20, 21, 22, 23, 24, 25, 26, 27, 28, 29, or 30 nucleotides) and a sense region having about 3 to about 25 (e.g., about 3, 4, 5, 6, 7, 8, 9, 10, 11, 12, 13, 14, 15, 16, 17, 18, 19, 20, 21, 22, 23, 24, or 25) nucleotides that are complementary to the antisense region.

By "RNAi inhibitor" is meant any molecule that can down regulate, reduce or inhibit RNA interference function or activity in a cell or organism. An RNAi inhibitor can down regulate, reduce or inhibit RNAi (e.g., RNAi mediated cleavage of a target polynucleotide, translational inhibition, or transcriptional silencing) by interaction with or interfering the function of any component of the RNAi pathway, including protein components such as RISC, or nucleic acid components such as miRNAs or siRNAs. A RNAi inhibitor can be a siNA molecule, an antisense molecule, an aptamer, or a small molecule that interacts with or interferes with the function of RISC, a miRNA, or a siRNA or any other component of the RNAi pathway in a cell or organism. By inhibiting RNAi (e.g., RNAi mediated cleavage of a target polynucleotide, translational inhibition, or transcriptional silencing), a RNAi inhibitor of the invention can be used to modulate (e.g, up-regulate or down regulate) the expression of a target gene. In one embodiment, a RNA inhibitor of the invention is used to up-regulate gene expression by interfering with (e.g., reducing or preventing) endogenous down-regulation or inhibition of gene expression through translational inhibition, transcriptional silencing, or RISC mediated cleavage of a polynucleotide (e.g., mRNA). By interfering with mechanisms of endogenous repression, silencing, or inhibition of gene expression, RNAi inhibitors of the invention can therefore be used to up-regulate gene expression for the treatment of diseases, traits, or conditions resulting from a loss of function. In one embodiment, the term "RNAi inhibitor" is used in place of the term "siNA" in the various embodiments herein, for example, with the effect of increasing gene expression for the treatment of loss of function diseases, traits, and/or conditions.

By "aptamer" or "nucleic acid aptamer" as used herein is meant a polynucleotide that binds specifically to a target molecule wherein the nucleic acid molecule has sequence that is distinct from sequence recognized by the target molecule in its natural setting. Alternately, an aptamer can be a nucleic acid molecule that binds to a target molecule where the target molecule does not naturally bind to a nucleic acid. The target molecule can be any molecule of interest. For example, the aptamer can be used to bind to a ligand-binding domain of a protein, thereby preventing interaction of the naturally occurring ligand with the protein. This is a non-limiting example and those in the art will recognize that other embodiments can be readily generated using techniques generally known in the art, see for example Gold et al., 1995, *Annu. Rev. Biochem.*, 64, 763; Brody and Gold, 2000, *J. Biotechnol.*, 74, 5; Sun, 2000, *Curr. Opin. Mol. Ther.*, 2, 100; Kusser, 2000, *J. Biotechnol.*, 74, 27; Hermann and Patel, 2000, *Science*, 287, 820; and Jayasena, 1999, *Clinical Chemistry*, 45, 1628. Aptamer molecules of the invention can be chemically modified as is generally known in the art or as described herein.

The term "antisense nucleic acid", as used herein, refers to a nucleic acid molecule that binds to target RNA by means of RNA-RNA or RNA-DNA or RNA-PNA (protein nucleic acid; Egholm et al., 1993 Nature 365, 566) interactions and alters the activity of the target RNA (for a review, see Stein and Cheng, 1993 Science 261, 1004 and Woolf et al., U.S. Pat. No. 5,849,902) by steric interaction or by RNase H mediated target recognition. Typically, antisense molecules are complementary to a target sequence along a single contiguous sequence of the antisense molecule. However, in certain embodiments, an antisense molecule can bind to substrate such that the substrate molecule forms a loop, and/or an antisense molecule can bind such that the antisense molecule forms a loop. Thus, the antisense molecule can be complementary to two (or even more) non-contiguous substrate sequences or two (or even more) non-contiguous sequence portions of an antisense molecule can be complementary to a target sequence or both. For a review of current antisense strategies, see Schmajuk et al., 1999, J. Biol. Chem., 274, 21783-21789, Delihas et al., 1997, Nature, 15, 751-753, Stein et al., 1997, Antisense N. A. Drug Dev., 7, 151, Crooke, 2000, Methods Enzymol., 313, 3-45; Crooke, 1998, Biotech. genet.

Eng. Rev., 15, 121-157, Crooke, 1997, Ad. Pharmacol., 40, 1-49. In addition, antisense DNA or antisense modified with 2'-MOE and other modifications as are known in the art can be used to target RNA by means of DNA-RNA interactions, thereby activating RNase H, which digests the target RNA in the duplex. The antisense oligonucleotides can comprise one or more RNAse H activating region, which is capable of activating RNAse H cleavage of a target RNA. Antisense DNA can be synthesized chemically or expressed via the use of a single stranded DNA expression vector or equivalent thereof. Antisense molecules of the invention can be chemically modified as is generally known in the art or as described herein.

By "modulate" is meant that the expression of the gene, or level of a RNA molecule or equivalent RNA molecules encoding one or more proteins or protein subunits, or activity of one or more proteins or protein subunits is up regulated or down regulated, such that expression, level, or activity is greater than or less than that observed in the absence of the modulator. For example, the term "modulate" can mean "inhibit," but the use of the word "modulate" is not limited to this definition.

By "inhibit", "down-regulate", or "reduce", it is meant that the expression of the gene, or level of RNA molecules or equivalent RNA molecules encoding one or more proteins or protein subunits, or activity of one or more proteins or protein subunits, is reduced below that observed in the absence of the nucleic acid molecules (e.g., siNA) of the invention. In one embodiment, inhibition, down-regulation or reduction with an siNA molecule is below that level observed in the presence of an inactive or attenuated molecule. In another embodiment, inhibition, down-regulation, or reduction with siNA molecules is below that level observed in the presence of, for example, an siNA molecule with scrambled sequence or with mismatches. In another embodiment, inhibition, down-regulation, or reduction of gene expression with a nucleic acid molecule of the instant invention is greater in the presence of the nucleic acid molecule than in its absence. In one embodiment, inhibition, down regulation, or reduction of gene expression is associated with post transcriptional silencing, such as RNAi mediated cleavage of a target nucleic acid molecule (e.g. RNA) or inhibition of translation. In one embodiment, inhibition, down regulation, or reduction of gene expression is associated with pretranscriptional silencing, such as by alterations in DNA methylation patterns and DNA chromatin structure.

By "up-regulate", or "promote", it is meant that the expression of the gene, or level of RNA molecules or equivalent RNA molecules encoding one or more proteins or protein subunits, or activity of one or more proteins or protein subunits, is increased above that observed in the absence of the nucleic acid molecules (e.g., siNA) of the invention. In one embodiment, up-regulation or promotion of gene expression with an siNA molecule is above that level observed in the presence of an inactive or attenuated molecule. In another embodiment, up-regulation or promotion of gene expression with siNA molecules is above that level observed in the presence of, for example, an siNA molecule with scrambled sequence or with mismatches. In another embodiment, up-regulation or promotion of gene expression with a nucleic acid molecule of the instant invention is greater in the presence of the nucleic acid molecule than in its absence. In one embodiment, up-regulation or promotion of gene expression is associated with inhibition of RNA mediated gene silencing, such as RNAi mediated cleavage or silencing of a coding or non-coding RNA target that down regulates, inhibits, or silences the expression of the gene of interest to be up-regulated. The down regulation of gene expression can, for example, be induced by a coding RNA or its encoded protein, such as through negative feedback or antagonistic effects. The down regulation of gene expression can, for example, be induced by a non-coding RNA having regulatory control over a gene of interest, for example by silencing expression of the gene via translational inhibition, chromatin structure, methylation, RISC mediated RNA cleavage, or translational inhibition. As such, inhibition or down regulation of targets that down regulate, suppress, or silence a gene of interest can be used to up-regulate or promote expression of the gene of interest toward therapeutic use.

In one embodiment, a RNAi inhibitor of the invention is used to up regulate gene expression by inhibiting RNAi or gene silencing. For example, a RNAi inhibitor of the invention can be used to treat loss of function diseases and conditions by up-regulating gene expression, such as in instances of haploinsufficiency where one allele of a particular gene harbors a mutation (e.g., a frameshift, missense, or nonsense mutation) resulting in a loss of function of the protein encoded by the mutant allele. In such instances, the RNAi inhibitor can be used to up regulate expression of the protein encoded by the wild type or functional allele, thus correcting the haploinsufficiency by compensating for the mutant or null allele. In another embodiment, a siNA molecule of the invention is used to down regulate expression of a toxic gain of function allele while a RNAi inhibitor of the invention is used concomitantly to up regulate expression of the wild type or functional allele, such as in the treatment of diseases, traits, or conditions herein or otherwise known in the art (see for example Rhodes et al., 2004, PNAS USA, 101:11147-11152 and Meisler et al. 2005, The Journal of Clinical Investigation, 115:2010-2017).

By "gene", or "target gene" or "target DNA", is meant a nucleic acid that encodes an RNA, for example, nucleic acid sequences including, but not limited to, structural genes encoding a polypeptide. A gene or target gene can also encode a functional RNA (fRNA) or non-coding RNA (ncRNA), such as small temporal RNA (stRNA), micro RNA (miRNA), small nuclear RNA (snRNA), short interfering RNA (siRNA), small nucleolar RNA (snRNA), ribosomal RNA (rRNA), transfer RNA (tRNA) and precursor RNAs thereof. Such non-coding RNAs can serve as target nucleic acid molecules for siNA mediated RNA interference in modulating the activity of fRNA or, ncRNA involved in functional or regulatory cellular processes. Abberant fRNA or ncRNA activity leading to disease can therefore be modulated by siNA molecules of the invention. siNA molecules targeting fRNA and ncRNA can also be used to manipulate or alter the genotype or phenotype of a subject, organism or cell, by intervening in cellular processes such as genetic imprinting, transcription, translation, or nucleic acid processing (e.g., transamination, methylation etc.). The target gene can be a gene derived from a cell, an endogenous gene, a transgene, or exogenous genes such as genes of a pathogen, for example a virus, which is present in the cell after infection thereof. The cell containing the target gene can be derived from or contained in any organism, for example a plant, animal, protozoan, virus, bacterium, or fungus. Non-limiting examples of plants include monocots, dicots, or gymnosperms. Non-limiting examples of animals include vertebrates or invertebrates. Non-limiting examples of fungi include molds or yeasts. For a review, see for example Snyder and Gerstein, 2003, *Science,* 300, 258-260.

By "non-canonical base pair" is meant any non-Watson Crick base pair, such as mismatches and/or wobble base pairs, including flipped mismatches, single hydrogen bond mismatches, trans-type mismatches, triple base interactions, and quadruple base interactions. Non-limiting examples of such non-canonical base pairs include, but are not limited to, AC reverse Hoogsteen, AC wobble, AU reverse Hoogsteen, GU wobble, AA N7 amino, CC 2-carbonyl-amino(H1)-N3-amino(H2), GA sheared, UC 4-carbonyl-amino, UU imino-carbonyl, AC reverse wobble, AU Hoogsteen, AU reverse Watson Crick, CG reverse Watson Crick, GC N3-amino-amino N3, AA N1-amino symmetric, AA N7-amino symmetric, GA N7-N1 amino-carbonyl, GA+ carbonyl-amino N7-NI, GG NI-carbonyl symmetric, GG N3-amino symmetric, CC carbonyl-amino symmetric, CC N3-amino symmetric, UU 2-carbonyl-imino symmetric, UU 4-carbonyl-imino symmetric, AA amino-N3, AA NI-amino, AC amino 2-carbonyl, AC N3-amino, AC N7-amino, AU amino-4-carbonyl, AU NI-imino, AU N3-imino, AU N7-imino, CC carbonyl-amino, GA amino-NI, GA amino-N7, GA carbonyl-amino, GA N3-amino, GC amino-N3, GC carbonyl-amino, GC N3-amino, GC N7-amino, GG amino-N7, GG carbonyl-imino, GG N7-amino, GU amino-2-carbonyl, GU carbonyl-imino, GU imino-2-carbonyl, GU N7-imino, psiU imino-2-carbonyl, UC 4-carbonyl-amino, UC imino-carbonyl, UU imino-4-carbonyl, AC C2-H-N3, GA carbonyl-C2-H, UU imino-4-carbonyl 2 carbonyl-C5-H, AC amino(A) N3(C)-carbonyl, GC imino amino-carbonyl, Gpsi imino-2-carbonyl amino-2-carbonyl, and GU imino amino-2-carbonyl base pairs.

By "HCV" as used herein is meant, any hepatitis C virus or HCV protein, peptide, or polypeptide having HCV activity, such as encoded by HCV Genbank Accession Nos. shown in Table I. The term HCV also refers to nucleic acid sequences encoding any HCV protein, peptide, or polypeptide having HCV activity. The term "HCV" is also meant to include other HCV encoding sequence, such as other HCV isoforms, mutant HCV genes, splice variants of HCV genes, and HCV gene polymorphisms. In one embodiment, the term HCV as used herein refers to cellular or host proteins or polynucleotides encoding such proteins or that are otherwise involved in HCV infection and/or replication.

By "target" as used herein is meant, any target protein, peptide, or polypeptide, such as encoded by Genbank Accession Nos. herein and in U.S. Ser. No. 10/923,536 and U.S. Ser. No. 10/444,853, both incorporated by reference herein. The term "target" also refers to nucleic acid sequences or target polynucleotide sequence encoding any target protein, peptide, or polypeptide, such as proteins, peptides, or polypeptides encoded by sequences having Genbank Accession Nos. shown herein and/or in U.S. Provisional Patent Application No. 60/363,124, U.S. Ser. No. 10/923,536, U.S. Ser. No. 10/444,853 and/or PCT/US03/05028. The target of interest can include target polynucleotide sequences, such as target DNA or target RNA. The term "target" is also meant to include other sequences, such as differing isoforms, mutant target genes, splice variants of target polynucleotides, target polymorphisms, and non-coding (e.g., ncRNA, miRNA, stRNA) or other regulatory polynucleotide sequences as described herein. Therefore, in various embodiments of the invention, a double stranded nucleic acid molecule of the invention (e.g., siNA) having complementarity to a target RNA can be used to inhibit or down regulate miRNA or other ncRNA activity. In one embodiment, inhibition of miRNA or ncRNA activity can be used to down regulate or inhibit gene expression (e.g., gene targets described herein or otherwise known in the art) or viral replication (e.g., viral targets described herein or otherwise known in the art) that is dependent on miRNA or ncRNA activity. In another embodiment, inhibition of miRNA or ncRNA activity by double stranded nucleic acid molecules of the invention (e.g. siNA) having complementarity to the miRNA or ncRNA can be used to up regulate or promote target gene expression (e.g., gene targets described herein or otherwise known in the art) where the expression of such genes is down regulated, suppressed, or silenced by the miRNA or ncRNA. Such up-regulation of gene expression can be used to treat diseases and conditions associated with a loss of function or haploinsufficiency as are generally known in the art.

By "pathway target" or "host target" is meant any target involved in pathways of gene expression or activity or cellular or host proteins or polynucleotides encoding such proteins or that are otherwise involved in HCV infection and/or replication. For example, any given target can have related pathway or host targets that can include upstream, downstream, or modifier genes in a biologic pathway. These pathway and host target genes can provide additive or synergistic effects in the treatment of diseases, conditions, and traits herein.

In one embodiment, the target is any target RNA or a portion thereof.

In one embodiment, the target is any target DNA or a portion thereof.

In one embodiment, the target is any target mRNA or a portion thereof.

In one embodiment, the target is any target miRNA or a portion thereof.

In one embodiment, the target is any target siRNA or a portion thereof.

In one embodiment, the target is any target stRNA or a portion thereof.

In one embodiment, the target is a target and or pathway target or a portion thereof.

In one embodiment, the target is any (e.g., one or more) of target sequences described herein and/or in U.S. Provisional Patent Application No. 60/363,124, U.S. Ser. No. 10/923, 536, and U.S. Ser. No. 10/444,853 and/or PCT/US03/05028, or a portion thereof. In one embodiment, the target is any (e.g., one or more) of target sequences shown in Tables I, II, or III or a portion thereof. In another embodiment, the target is a siRNA, miRNA, or stRNA corresponding to any (e.g., one or more) target, upper strand, or lower strand sequence shown in Table II or Table III or a portion thereof. In another embodiment, the target is any siRNA, miRNA, or stRNA corresponding any (e.g., one or more) sequence corresponding to a sequence herein or described in U.S. Provisional Patent Application No. 60/363,124, U.S. Ser. No. 10/923,536, U.S. Ser. No. 10/444,853 and/or PCT/US03/05028.

By "homologous sequence" is meant, a nucleotide sequence that is shared by one or more polynucleotide sequences, such as genes, gene transcripts and/or non-coding polynucleotides. For example, a homologous sequence can be a nucleotide sequence that is shared by two or more genes encoding related but different proteins, such as different members of a gene family, different protein epitopes, different protein isoforms or completely divergent genes, such as a cytokine and its corresponding receptors. A homologous sequence can be a nucleotide sequence that is shared by two or more non-coding polynucleotides, such as noncoding DNA or RNA, regulatory sequences, introns, and sites of transcriptional control or regulation. Homologous sequences can also include conserved sequence regions shared by more than one polynucleotide sequence. Homology does not need to be perfect homology (e.g., 100%), as partially homologous sequences are also contemplated by the instant invention (e.g., 99%, 98%, 97%, 96%, 95%, 94%, 93%, 92%, 91%, 90%, 89%, 88%, 87%, 86%, 85%, 84%, 83%, 82%, 81%, 80% etc.).

By "conserved sequence region" is meant, a nucleotide sequence of one or more regions in a polynucleotide does not vary significantly between generations or from one biological system, subject, or organism to another biological system, subject, or organism. The polynucleotide can include both coding and non-coding DNA and RNA.

By "sense region" is meant a nucleotide sequence of a siNA molecule having complementarity to an antisense region of the siNA molecule. In addition, the sense region of a siNA molecule can comprise a nucleic acid sequence having homology with a target nucleic acid sequence. In one embodiment, the sense region of the siNA molecule is referred to as the sense strand or passenger strand.

By "antisense region" is meant a nucleotide sequence of a siNA molecule having complementarity to a target nucleic acid sequence. In addition, the antisense region of a siNA molecule can optionally comprise a nucleic acid sequence having complementarity to a sense region of the siNA molecule. In one embodiment, the antisense region of the siNA molecule is referred to as the antisense strand or guide strand.

By "target nucleic acid" or "target polynucleotide" is meant any nucleic acid sequence (e.g, any target and/or pathway target sequence) whose expression or activity is to be modulated. The target nucleic acid can be DNA or RNA. In one embodiment, a target nucleic acid of the invention is target RNA or DNA.

By "complementarity" is meant that a nucleic acid can form hydrogen bond(s) with another nucleic acid sequence by either traditional Watson-Crick or other non-traditional types as described herein. In one embodiment, a double stranded nucleic acid molecule of the invention, such as an siNA molecule, wherein each strand is between 15 and 30 nucleotides in length, comprises between about 10% and about 100% (e.g., about 10%, 20%, 30%, 40%, 50%, 60%, 70%, 80%, 90%, or 100%) complementarity between the two strands of the double stranded nucleic acid molecule. In another embodiment, a double stranded nucleic acid molecule of the invention, such as an siNA molecule, where one strand is the sense strand and the other stand is the antisense strand, wherein each strand is between 15 and 30 nucleotides in length, comprises between at least about 10% and about 100% (e.g., at least about 10%, 20%, 30%, 40%, 50%, 60%, 70%, 80%, 90%, or 100%) complementarity between the nucleotide sequence in the antisense strand of the double stranded nucleic acid molecule and the nucleotide sequence of its corresponding target nucleic acid molecule, such as a target RNA or target mRNA or viral RNA. In one embodiment, a double stranded nucleic acid molecule of the invention, such as an siNA molecule, where one strand comprises nucleotide sequence that is referred to as the sense region and the other strand comprises a nucleotide sequence that is referred to as the antisense region, wherein each strand is between 15 and 30 nucleotides in length, comprises between about 10% and about 100% (e.g., about 10%, 20%, 30%, 40%, 50%, 60%, 70%, 80%, 90%, or 100%) complementarity between the sense region and the antisense region of the double stranded nucleic acid molecule. In reference to the nucleic molecules of the present invention, the binding free energy for a nucleic acid molecule with its complementary sequence is sufficient to allow the relevant function of the nucleic acid to proceed, e.g., RNAi activity. Determination of binding free energies for nucleic acid molecules is well known in the art (see, e.g., Turner et al., 1987, *CSH Symp. Quant. Biol. LII pp.* 123-133; Frier et al., 1986, *Proc. Nat. Acad. Sci. USA* 83:9373-9377; Turner et al., 1987, *J. Am. Chem. Soc.* 109:3783-3785). A percent complementarity indicates the percentage of contiguous residues in a nucleic acid molecule that can form hydrogen bonds (e.g., Watson-Crick base pairing) with a second nucleic acid sequence (e.g., 5, 6, 7, 8, 9, or 10 nucleotides out of a total of 10 nucleotides in the first oligonucleotide being based paired to a second nucleic acid sequence having 10 nucleotides represents 50%, 60%, 70%, 80%, 90%, and 100% complementary respectively). In one embodiment, a siNA molecule of the invention has perfect complementarity between the sense strand or sense region and the antisense strand or antisense region of the siNA molecule. In one embodiment, a siNA molecule of the invention is perfectly complementary to a corresponding target nucleic acid molecule. "Perfectly complementary" means that all the contiguous residues of a nucleic acid sequence will hydrogen bond with the same number of contiguous residues in a second nucleic acid sequence. In one embodiment, a siNA molecule of the invention comprises about 15 to about 30 or more (e.g., about 15, 16, 17, 18, 19, 20, 21, 22, 23, 24, 25, 26, 27, 28, 29, or 30 or more) nucleotides that are complementary to one or more target nucleic acid molecules or a portion thereof. In one embodiment, a siNA molecule of the invention has partial complementarity (i.e., less than 100% complementarity) between the sense strand or sense region and the antisense strand or antisense region of the siNA molecule or between the antisense strand or antisense region of the siNA molecule and a corresponding target nucleic acid molecule. For example, partial complementarity can include various mismatches or non-based paired nucleotides (e.g., 1, 2, 3, 4, 5 or more mismatches or non-based paired nucleotides) within the siNA structure which can result in bulges, loops, or overhangs that result between the between the sense strand or sense region and the antisense strand or antisense region of the siNA molecule or between the anti- sense strand or antisense region of the siNA molecule and a corresponding target nucleic acid molecule.

In one embodiment, a double stranded nucleic acid molecule of the invention, such as siNA molecule, has perfect complementarity between the sense strand or sense region and the antisense strand or antisense region of the nucleic acid molecule. In one embodiment, double stranded nucleic acid molecule of the invention, such as siNA molecule, is perfectly complementary to a corresponding target nucleic acid molecule.

In one embodiment, double stranded nucleic acid molecule of the invention, such as siNA molecule, has partial complementarity (i.e., less than 100% complementarity) between the sense strand or sense region and the antisense strand or antisense region of the double stranded nucleic acid molecule or between the antisense strand or antisense region of the nucleic acid molecule and a corresponding target nucleic acid molecule. For example, partial complementarity can include various mismatches or non-base paired nucleotides (e.g., 1, 2, 3, 4, 5 or more mismatches or non-based paired nucleotides, such as nucleotide bulges) within the double stranded nucleic acid molecule, structure which can result in bulges, loops, or overhangs that result between the sense strand or sense region and the antisense strand or antisense region of the double stranded nucleic acid molecule or between the antisense strand or antisense region of the double stranded nucleic acid molecule and a corresponding target nucleic acid molecule.

In one embodiment, double stranded nucleic acid molecule of the invention is a microRNA (miRNA). By "microRNA" or "miRNA" is meant, a small double stranded RNA that regulates the expression of target messenger RNAs either by mRNA cleavage, translational repression/inhibition or heterochromatic silencing (see for example Ambros, 2004, Nature, 431, 350-355; Bartel, 2004, Cell, 116, 281-297; Cullen, 2004, Virus Research., 102, 3-9; He et al., 2004, Nat.

Rev. Genet., 5, 522-531; Ying et al., 2004, Gene, 342, 25-28; and Sethupathy et al., 2006, RNA, 12:192-197). In one embodiment, the microRNA of the invention, has partial complementarity (i.e., less than 100% complementarity) between the sense strand or sense region and the antisense strand or antisense region of the miRNA molecule or between the antisense strand or antisense region of the miRNA and a corresponding target nucleic acid molecule. For example, partial complementarity can include various mismatches or non-base paired nucleotides (e.g., 1, 2, 3, 4, 5 or more mismatches or non-based paired nucleotides, such as nucleotide bulges) within the double stranded nucleic acid molecule, structure which can result in bulges, loops, or overhangs that result between the sense strand or sense region and the antisense strand or antisense region of the miRNA or between the antisense strand or antisense region of the miRNA and a corresponding target nucleic acid molecule.

In one embodiment, siNA molecules of the invention that down regulate or reduce target gene expression are used for treating, preventing or reducing HCV infection, liver failure, hepatocellular carcinoma, or cirrhosis in a subject or organism as described herein or otherwise known in the art.

In one embodiment of the present invention, each sequence of a siNA molecule of the invention is independently about 15 to about 30 nucleotides in length, in specific embodiments about 15, 16, 17, 18, 19, 20, 21, 22, 23, 24, 25, 26, 27, 28, 29, or 30 nucleotides in length. In another embodiment, the siNA duplexes of the invention independently comprise about 15 to about 30 base pairs (e.g., about 15, 16, 17, 18, 19, 20, 21, 22, 23, 24, 25, 26, 27, 28, 29, or 30). In another embodiment, one or more strands of the siNA molecule of the invention independently comprises about 15 to about 30 nucleotides (e.g., about 15, 16, 17, 18, 19, 20, 21, 22, 23, 24, 25, 26, 27, 28, 29, or 30) that are complementary to a target nucleic acid molecule. In yet another embodiment, siNA molecules of the invention comprising hairpin or circular structures are about 35 to about 55 (e.g., about 35, 40, 45, 50 or 55) nucleotides in length, or about 38 to about 44 (e.g., about 38, 39, 40, 41, 42, 43, or 44) nucleotides in length and comprising about 15 to about 25 (e.g., about 15, 16, 17, 18, 19, 20, 21, 22, 23, 24, or 25) base pairs. Exemplary siNA molecules of the invention are shown in Tables II and III and/or FIGS. 4-5.

As used herein "cell" is used in its usual biological sense, and does not refer to an entire multicellular organism, e.g., specifically does not refer to a human. The cell can be present in an organism, e.g., birds, plants and mammals such as humans, cows, sheep, apes, monkeys, swine, dogs, and cats. The cell can be prokaryotic (e.g., bacterial cell) or eukaryotic (e.g., mammalian or plant cell). The cell can be of somatic or germ line origin, totipotent or pluripotent, dividing or non-dividing. The cell can also be derived from or can comprise a gamete or embryo, a stem cell, or a fully differentiated cell. The cell can be an isolated cell, purified cell, or substantially purified cell as is generally recognized in the art.

The siNA molecules of the invention are added directly, or can be complexed with cationic lipids, packaged within liposomes, or otherwise delivered to target cells or tissues. The nucleic acid or nucleic acid complexes can be locally administered to relevant tissues ex vivo, or in vivo through local delivery to the lung, with or without their incorporation in biopolymers. In particular embodiments, the nucleic acid molecules of the invention comprise sequences shown in Tables II-III and/or FIGS. 4-5. Examples of such nucleic acid molecules consist essentially of sequences defined in these tables and figures. Furthermore, the chemically modified constructs described in Table IV and the lipid nanoparticle (LNP) formulations shown in Table VI can be applied to any siNA sequence or group of siNA sequences of the invention.

In another aspect, the invention provides mammalian cells containing one or more siNA molecules of this invention. The one or more siNA molecules can independently be targeted to the same or different sites within a target polynucleotide of the invention.

By "RNA" is meant a molecule comprising at least one ribonucleotide residue. By "ribonucleotide" is meant a nucleotide with a hydroxyl group at the 2' position of a β-D-ribofuranose moiety. The terms include double-stranded RNA, single-stranded RNA, isolated RNA such as partially purified RNA, essentially pure RNA, synthetic RNA, recombinantly produced RNA, as well as altered RNA that differs from naturally occurring RNA by the addition, deletion, substitution and/or alteration of one or more nucleotides. Such alterations can include addition of non-nucleotide material, such as to the end(s) of the siNA or internally, for example at one or more nucleotides of the RNA. Nucleotides in the RNA molecules of the instant invention can also comprise non-standard nucleotides, such as non-naturally occurring nucleotides or chemically synthesized nucleotides or deoxynucleotides. These altered RNAs can be referred to as analogs or analogs of naturally-occurring RNA.

By "subject" is meant an organism, which is a donor or recipient of explanted cells or the cells themselves. "Subject" also refers to an organism to which the nucleic acid molecules of the invention can be administered. A subject can be a mammal or mammalian cells, including a human or human cells. In one embodiment, the subject is an infant (e.g., subjects that are less than 1 month old, or 1, 2, 3, 4, 5, 6, 7, 8, 9 10, 11, or 12 months old). In one embodiment, the subject is a toddler (e.g., 1, 2, 3, 4, 5 or 6 years old). In one embodiment, the subject is a senior (e.g., anyone over the age of about 65 years of age).

By "chemical modification" as used herein is meant any modification of chemical structure of the nucleotides that differs from nucleotides of native siRNA or RNA. The term "chemical modification" encompasses the addition, substitution, or modification of native siRNA or RNA nucleosides and nucleotides with modified nucleosides and modified nucleotides as described herein or as is otherwise known in the art. Non-limiting examples of such chemical modifications include without limitation compositions having any of Formulae I, II, III, IV, V, VI, or VII herein, phosphorothioate internucleotide linkages, 2'-deoxyribonucleotides, 2'-O-methyl ribonucleotides, 2'-deoxy-2'-fluoro ribonucleotides, 4'-thio ribonucleotides, 2'-O-trifluoromethyl nucleotides, 2'-O-ethyl-trifluoromethoxy nucleotides, 2'-O-difluoromethoxy-ethoxy nucleotides (see for example U.S. Ser. No. 10/981,966 filed Nov. 5, 2004, incorporated by reference herein), FANA, "universal base" nucleotides, "acyclic" nucleotides, 5-C-methyl nucleotides, terminal glyceryl and/or inverted deoxy abasic residue incorporation, or a modification having any of Formulae I-VII herein. In one embodiment, the nucleic acid molecules of the invention (e.g, dsRNA, siNA etc.) are partially modified (e.g., about 5%, 10,%, 15%, 20%, 25%, 30%, 35%, 40%, 45%, 50%, 55%, 60%, 65%, 70%, 75%, 80%, 85%, 90%, or 95% modified) with chemical modifications. In another embodiment, the nucleic acid molecules of the invention (e.g, dsRNA, siNA etc.) are completely modified (e.g., about 100% modified) with chemical modifications.

The term "phosphorothioate" as used herein refers to an internucleotide linkage having Formula I, wherein Z and/or W comprise a sulfur atom. Hence, the term phosphorothioate refers to both phosphorothioate and phosphorodithioate internucleotide linkages.

The term "phosphonoacetate" as used herein refers to an internucleotide linkage having Formula I, wherein Z and/or W comprise an acetyl or protected acetyl group.

The term "thiophosphonoacetate" as used herein refers to an internucleotide linkage having Formula I, wherein Z comprises an acetyl or protected acetyl group and W comprises a sulfur atom or alternately W comprises an acetyl or protected acetyl group and Z comprises a sulfur atom.

The term "universal base" as used herein refers to nucleotide base analogs that form base pairs with each of the natural DNA/RNA bases with little discrimination between them. Non-limiting examples of universal bases include C-phenyl, C-naphthyl and other aromatic derivatives, inosine, azole carboxamides, and nitroazole derivatives such as 3-nitropyrrole, 4-nitroindole, 5-nitroindole, and 6-nitroindole as known in the art (see for example Loakes, 2001, *Nucleic Acids Research*, 29, 2437-2447).

The term "acyclic nucleotide" as used herein refers to any nucleotide having an acyclic ribose sugar, for example where any of the ribose carbons (C1, C2, C3, C4, or C5), are independently or in combination absent from the nucleotide.

The nucleic acid molecules of the instant invention, individually, or in combination or in conjunction with other drugs, can be used to for preventing or treating diseases, disorders, conditions, and traits described herein or otherwise known in the art, in a subject or organism. For example, the siNA molecules can be administered to a subject or can be administered to other appropriate cells evident to those skilled in the art, individually or in combination with one or more drugs under conditions suitable for the treatment.

In one embodiment, the siNA molecules of the invention can be administered to a subject or can be administered to other appropriate cells evident to those skilled in the art, individually or in combination with one or more drugs under conditions suitable for the treatment.

In a further embodiment, the siNA molecules can be used in combination with other known treatments to prevent or treat in a subject or organism. For example, the described molecules could be used in combination with one or more known compounds, treatments, or procedures to prevent or treat diseases, disorders, conditions, and traits described herein in a subject or organism as are known in the art.

In one embodiment, the invention features an expression vector comprising a nucleic acid sequence encoding at least one siNA molecule of the invention, in a manner which allows expression of the siNA molecule. For example, the vector can contain sequence(s) encoding both strands of a siNA molecule comprising a duplex. The vector can also contain sequence(s) encoding a single nucleic acid molecule that is self-complementary and thus forms a siNA molecule. Non-limiting examples of such expression vectors are described in Paul et al., 2002, *Nature Biotechnology*, 19, 505; Miyagishi and Taira, 2002, *Nature Biotechnology*, 19, 497; Lee et al., 2002, *Nature Biotechnology*, 19, 500; and Novina et al., 2002, *Nature Medicine*, advance online publication doi: 10.1038/nm725.

In another embodiment, the invention features a mammalian cell, for example, a human cell, including an expression vector of the invention.

In yet another embodiment, the expression vector of the invention comprises a sequence for a siNA molecule having complementarity to a RNA molecule referred to by a Genbank Accession numbers, for example Genbank Accession Nos. described herein or in U.S. Provisional Patent Application No. 60/363,124, U.S. Ser. No. 10/923,536, U.S. Ser. No. 10/444,853, and/or PCT/US03/05028.

In one embodiment, an expression vector of the invention comprises a nucleic acid sequence encoding two or more siNA molecules, which can be the same or different.

In another aspect of the invention, siNA molecules that interact with target RNA molecules and down-regulate gene encoding target RNA molecules (for example target RNA molecules referred to by Genbank Accession numbers herein) are expressed from transcription units inserted into DNA or RNA vectors. The recombinant vectors can be DNA plasmids or viral vectors. siNA expressing viral vectors can be constructed based on, but not limited to, adeno-associated virus, retrovirus, adenovirus, or alphavirus. The recombinant vectors capable of expressing the siNA molecules can be delivered as described herein, and persist in target cells. Alternatively, viral vectors can be used that provide for transient expression of siNA molecules. Such vectors can be repeatedly administered as necessary. Once expressed, the siNA molecules bind and down-regulate gene function or expression via RNA interference (RNAi). Delivery of siNA expressing vectors can be systemic, such as by intravenous or intramuscular administration, by administration to target cells ex-planted from a subject followed by reintroduction into the subject, or by any other means that would allow for introduction into the desired target cell.

By "vectors" is meant any nucleic acid- and/or viral-based technique used to deliver a desired nucleic acid.

Other features and advantages of the invention will be apparent from the following description of the preferred embodiments thereof, and from the claims.

BRIEF DESCRIPTION OF THE DRAWINGS

FIG. 1 shows a non-limiting example of a scheme for the synthesis of siNA molecules. The complementary siNA sequence strands, strand 1 and strand 2, are synthesized in tandem and are connected by a cleavable linkage, such as a nucleotide succinate or abasic succinate, which can be the same or different from the cleavable linker used for solid phase synthesis on a solid support. The synthesis can be either solid phase or solution phase, in the example shown, the synthesis is a solid phase synthesis. The synthesis is performed such that a protecting group, such as a dimethoxytrityl group, remains intact on the terminal nucleotide of the tandem oligonucleotide. Upon cleavage and deprotection of the oligonucleotide, the two siNA strands spontaneously hybridize to form a siNA duplex, which allows the purification of the duplex by utilizing the properties of the terminal protecting group, for example by applying a trityl on purification method wherein only duplexes/oligonucleotides with the terminal protecting group are isolated.

FIG. 4A: The sense strand comprises 21 nucleotides wherein the two terminal 3'-nucleotides are optionally base paired and wherein all nucleotides present are ribonucleotides except for (N N) nucleotides, which can comprise ribonucleotides, deoxynucleotides, universal bases, or other chemical modifications described herein. The antisense strand comprises 21 nucleotides, optionally having a 3'-terminal glyceryl moiety wherein the two terminal 3'-nucleotides are optionally complementary to the target RNA sequence, and wherein all nucleotides present are ribonucleotides except for (N N) nucleotides, which can comprise ribonucleotides, deoxynucleotides, universal bases, or other chemical modifications described herein. A modified internucleotide linkage, such as a phosphorothioate, phosphorodithioate or other modified internucleotide linkage as described herein, shown as "s", optionally connects the (N N) nucleotides in the antisense strand.

FIG. 4B: The sense strand comprises 21 nucleotides wherein the two terminal 3'-nucleotides are optionally base paired and wherein all pyrimidine nucleotides that may be present are 2'deoxy-2'-fluoro modified nucleotides and all purine nucleotides that may be present are 2'-O-methyl modified nucleotides except for (N N) nucleotides, which can comprise ribonucleotides, deoxynucleotides, universal bases, or other chemical modifications described herein. The antisense strand comprises 21 nucleotides, optionally having a 3'-terminal glyceryl moiety and wherein the two terminal 3'-nucleotides are optionally complementary to the target RNA sequence, and wherein all pyrimidine nucleotides that may be present are 2'-deoxy-2'-fluoro modified nucleotides and all purine nucleotides that may be present are 2'-O-methyl modified nucleotides except for (N N) nucleotides, which can comprise ribonucleotides, deoxynucleotides, universal bases, or other chemical modifications described herein. A modified internucleotide linkage, such as a phosphorothioate, phosphorodithioate or other modified internucleotide linkage as described herein, shown as "s", optionally connects the (N N) nucleotides in the sense and antisense strand.

FIG. 4C: The sense strand comprises 21 nucleotides having 5'- and 3'-terminal cap moieties wherein the two terminal 3'-nucleotides are optionally base paired and wherein all pyrimidine nucleotides that may be present are 2'-O-methyl or 2'-deoxy-2'-fluoro modified nucleotides except for (N N) nucleotides, which can comprise ribonucleotides, deoxynucleotides, universal bases, or other chemical modifications described herein. The antisense strand comprises 21 nucleotides, optionally having a 3'-terminal glyceryl moiety and wherein the two terminal 3'-nucleotides are optionally complementary to the target RNA sequence, and wherein all pyrimidine nucleotides that may be present are 2'-deoxy-2'-fluoro modified nucleotides except for (N N) nucleotides, which can comprise ribonucleotides, deoxynucleotides, universal bases, or other chemical modifications described herein. A modified internucleotide linkage, such as a phosphorothioate, phosphorodithioate or other modified internucleotide linkage as described herein, shown as "s", optionally connects the (N N) nucleotides in the antisense strand.

FIG. 4D: The sense strand comprises 21 nucleotides having 5'- and 3'-terminal cap moieties wherein the two terminal 3'-nucleotides are optionally base paired and wherein all pyrimidine nucleotides that may be present are 2'-deoxy-2'-fluoro modified nucleotides except for (N N) nucleotides, which can comprise ribonucleotides, deoxynucleotides, universal bases, or other chemical modifications described herein and wherein and all purine nucleotides that may be present are 2'-deoxy nucleotides. The antisense strand comprises 21 nucleotides, optionally having a 3'-terminal glyceryl moiety and wherein the two terminal 3'-nucleotides are optionally complementary to the target RNA sequence, wherein all pyrimidine nucleotides that may be present are 2'-deoxy-2'-fluoro modified nucleotides and all purine nucleotides that may be present are 2'-O-methyl modified nucleotides except for (N N) nucleotides, which can comprise ribonucleotides, deoxynucleotides, universal bases, or other chemical modifications described herein. A modified internucleotide linkage, such as a phosphorothioate, phosphorodithioate or other modified internucleotide linkage as described herein, shown as "s", optionally connects the (N N) nucleotides in the antisense strand.

FIG. 4E: The sense strand comprises 21 nucleotides having 5'- and 3'-terminal cap moieties wherein the two terminal 3'-nucleotides are optionally base paired and wherein all pyrimidine nucleotides that may be present are 2'-deoxy-2'-fluoro modified nucleotides except for (N N) nucleotides, which can comprise ribonucleotides, deoxynucleotides, universal bases, or other chemical modifications described herein. The antisense strand comprises 21 nucleotides, optionally having a 3'-terminal glyceryl moiety and wherein the two terminal 3'-nucleotides are optionally complementary to the target RNA sequence, and wherein all pyrimidine nucleotides that may be present are 2'-deoxy-2'-fluoro modified nucleotides and all purine nucleotides that may be present are 2'-O-methyl modified nucleotides except for (N N) nucleotides, which can comprise ribonucleotides, deoxynucleotides, universal bases, or other chemical modifications described herein. A modified internucleotide linkage, such as a phosphorothioate, phosphorodithioate or other modified internucleotide linkage as described herein, shown as "s", optionally connects the (N N) nucleotides in the antisense strand.

FIG. 4F: The sense strand comprises 21 nucleotides having 5'- and 3'-terminal cap moieties wherein the two terminal 3'-nucleotides are optionally base paired and wherein all pyrimidine nucleotides that may be present are 2'-deoxy-2'-fluoro modified nucleotides except for (N N) nucleotides, which can comprise ribonucleotides, deoxynucleotides, universal bases, or other chemical modifications described herein and wherein and all purine nucleotides that may be present are 2'-deoxy nucleotides. The antisense strand comprises 21 nucleotides, optionally having a 3'-terminal glyceryl moiety and wherein the two terminal 3'-nucleotides are optionally complementary to the target RNA sequence, and having one 3'-terminal phosphorothioate internucleotide linkage and wherein all pyrimidine nucleotides that may be present are 2'-deoxy-2'-fluoro modified nucleotides and all purine nucleotides that may be present are 2'-deoxy nucleotides except for (N N) nucleotides, which can comprise ribonucleotides, deoxynucleotides, universal bases, or other chemical modifications described herein. A modified internucleotide linkage, such as a phosphorothioate, phosphorodithioate or other modified internucleotide linkage as described herein, shown as "s", optionally connects the (N N) nucleotides in the antisense strand. The antisense strand of constructs A-F comprise sequence complementary to any target nucleic acid sequence of the invention. Furthermore, when a glyceryl moiety (L) is present at the 3'-end of the antisense strand for any construct shown in FIG. 4A-F, the modified internucleotide linkage is optional.

FIG. 6A-C shows non-limiting examples of different siNA constructs of the invention.

Figure 6A:
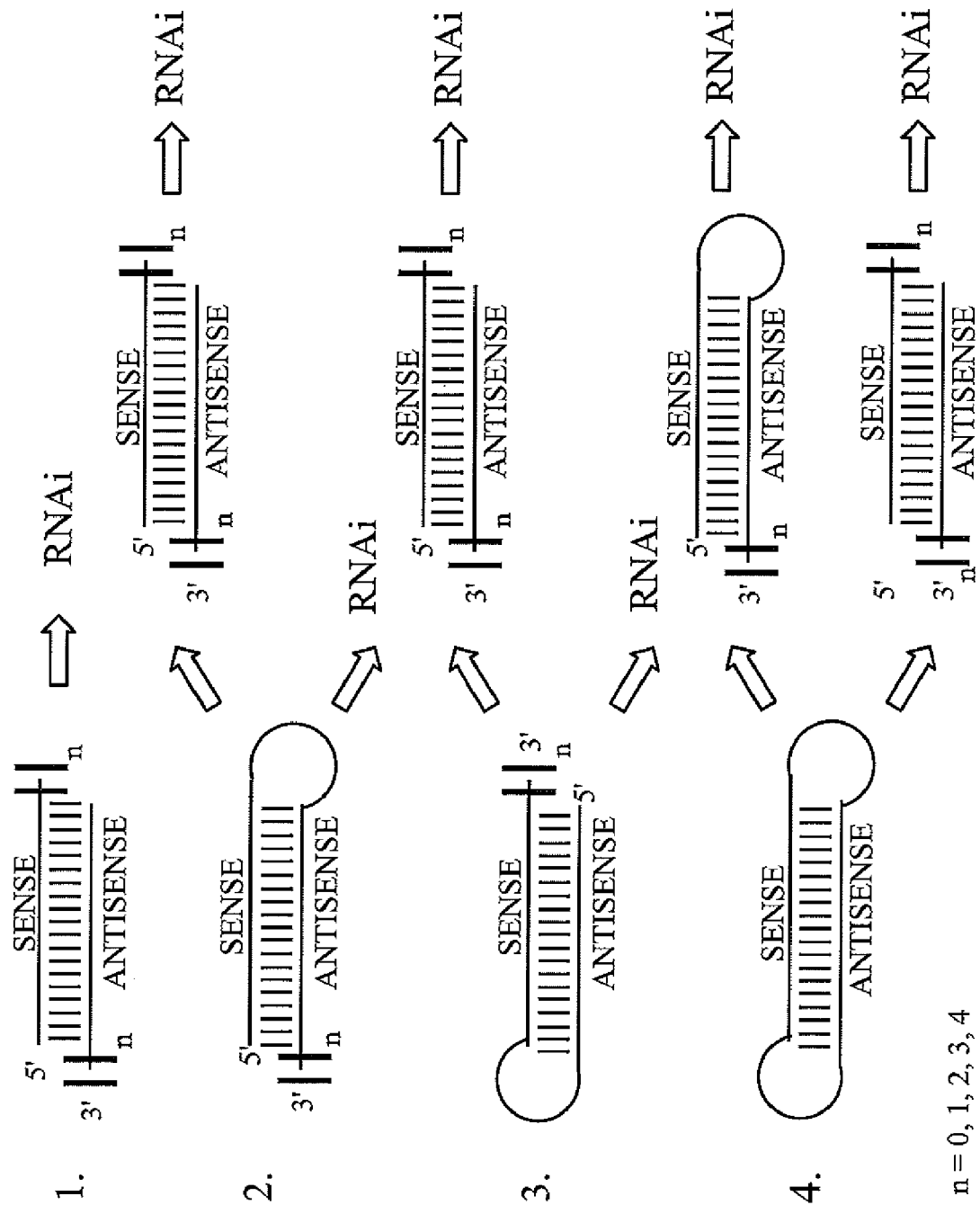

The examples shown in FIG. 6A (constructs 1, 2, and 3) have 19 representative base pairs; however, different embodiments of the invention include any number of base pairs described herein. Bracketed regions represent nucleotide overhangs, for example, comprising about 1, 2, 3, or 4 nucleotides in length, preferably about 2 nucleotides. Constructs 1 and 2 can be used independently for RNAi activity. Construct 2 can comprise a polynucleotide or non-nucleotide linker, which can optionally be designed as a biodegradable linker. In one embodiment, the loop structure shown in construct 2 can comprise a biodegradable linker that results in the formation of construct 1 in vivo and/or in vitro. In another example, construct 3 can be used to generate construct 2 under the same principle wherein a linker is used to generate the active siNA construct 2 in vivo and/or in vitro, which can optionally utilize another biodegradable linker to generate the active siNA construct 1 in vivo and/or in vitro. As such, the stability and/or activity of the siNA constructs can be modulated based on the design of the siNA construct for use in vivo or in vitro and/or in vitro.

Figure 6B:
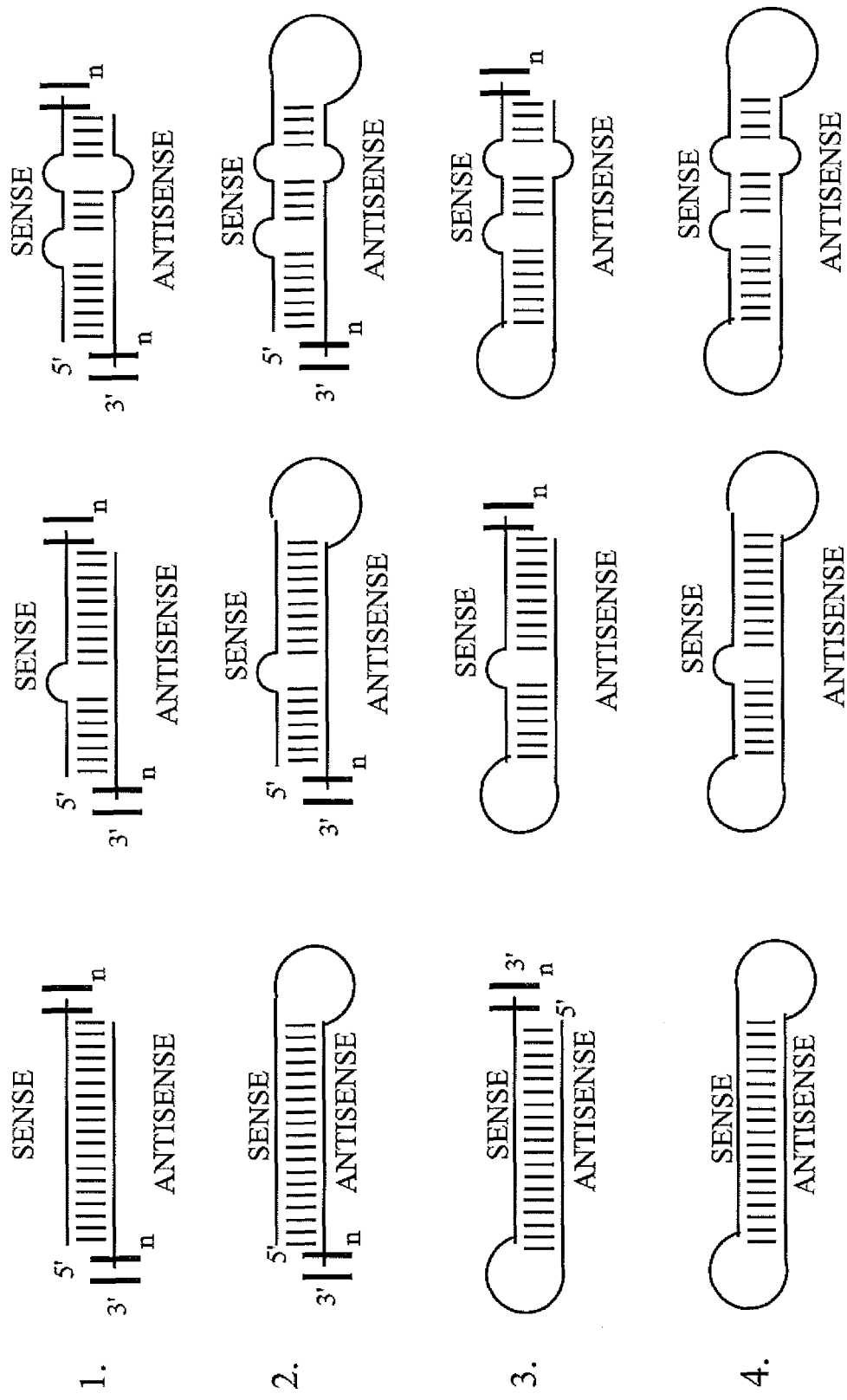

The examples shown in FIG. 6B represent different variations of double stranded nucleic acid molecule of the invention, such as microRNA, that can include overhangs, bulges, loops, and stem-loops resulting from partial complementarity. Such motifs having bulges, loops, and stem-loops are generally characteristics of miRNA. The bulges, loops, and stem-loops can result from any degree of partial complementarity, such as mismatches or bulges of about 1, 2, 3, 4, 5, 6, 7, 8, 9, 10 or more nucleotides in one or both strands of the double stranded nucleic acid molecule of the invention.

The example shown in FIG. 6C represents a model double stranded nucleic acid molecule of the invention comprising a 19 base pair duplex of two 21 nucleotide sequences having dinucleotide 3'-overhangs. The top strand (1) represents the sense strand (passenger strand), the middle strand (2) represents the antisense (guide strand), and the lower strand (3) represents a target polynucleotide sequence. The dinucleotide overhangs (NN) can comprise sequence derived from the target polynucleotide. For example, the 3'-(NN) sequence in the guide strand can be complementary to the 5'-[NN] sequence of the target polynucleotide. In addition, the 5'-(NN) sequence of the passenger strand can comprise the same sequence as the 5'-[NN] sequence of the target polynucleotide sequence. In other embodiments, the overhangs (NN) are not derived from the target polynucleotide sequence, for example where the 3'-(NN) sequence in the guide strand are not complementary to the 5'-[NN] sequence of the target polynucleotide and the 5'-(NN) sequence of the passenger strand can comprise different sequence from the 5'-[NN] sequence of the target polynucleotide sequence. In additional embodiments, any (NN) nucleotides are chemically modified, e.g., as 2'-O-methyl, 2'-deoxy-2'-fluoro, and/or other modifications herein. Furthermore, the passenger strand can comprise a ribonucleotide position N of the passenger strand. For the representative 19 base pair 21 mer duplex shown, position N can be 9 nucleotides in from the 3' end of the passenger strand. However, in duplexes of differing length, the position N is determined based on the 5'-end of the guide strand by counting 11 nucleotide positions in from the 5'-terminus of the guide strand and picking the corresponding base paired nucleotide in the passenger strand. Cleavage by Ago2 takes place between positions 10 and 11 as indicated by the arrow. In additional embodiments, there are two ribonucleotides, NN, at positions 10 and 11 based on the 5'-end of the guide strand by counting 10 and 11 nucleotide positions in from the 5'-terminus of the guide strand and picking the corresponding base paired nucleotides in the passenger strand.

Figure 7:
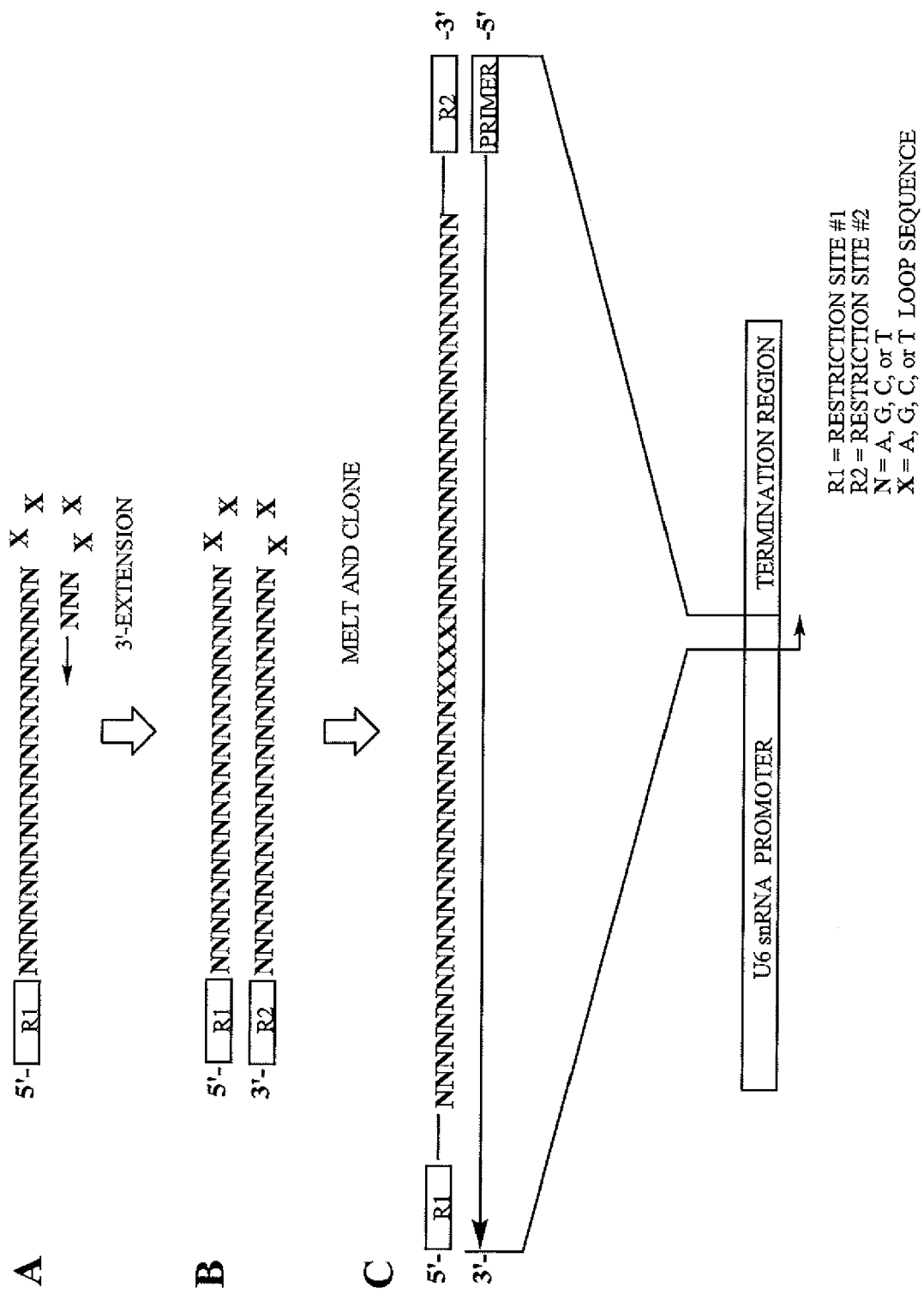

FIG. 7A-C is a diagrammatic representation of a scheme utilized in generating an expression cassette to generate siNA hairpin constructs.

FIG. 7A: A DNA oligomer is synthesized with a 5'-restriction site (R1) sequence followed by a region having sequence identical (sense region of siNA) to a predetermined target sequence, wherein the sense region comprises, for example, about 19, 20, 21, or 22 nucleotides (N) in length, which is followed by a loop sequence of defined sequence (X), comprising, for example, about 3 to about 10 nucleotides.

FIG. 7B: The synthetic construct is then extended by DNA polymerase to generate a hairpin structure having self-complementary sequence that will result in a siNA transcript having specificity for a target sequence and having self-complementary sense and antisense regions.

FIG. 7C: The construct is heated (for example to about 95° C.) to linearize the sequence, thus allowing extension of a complementary second DNA strand using a primer to the 3'-restriction sequence of the first strand. The double-stranded DNA is then inserted into an appropriate vector for expression in cells. The construct can be designed such that a 3'-terminal nucleotide overhang results from the transcription, for example, by engineering restriction sites and/or utilizing a poly-U termination region as described in Paul et al., 2002, *Nature Biotechnology*, 29, 505-508.

Figure 8:
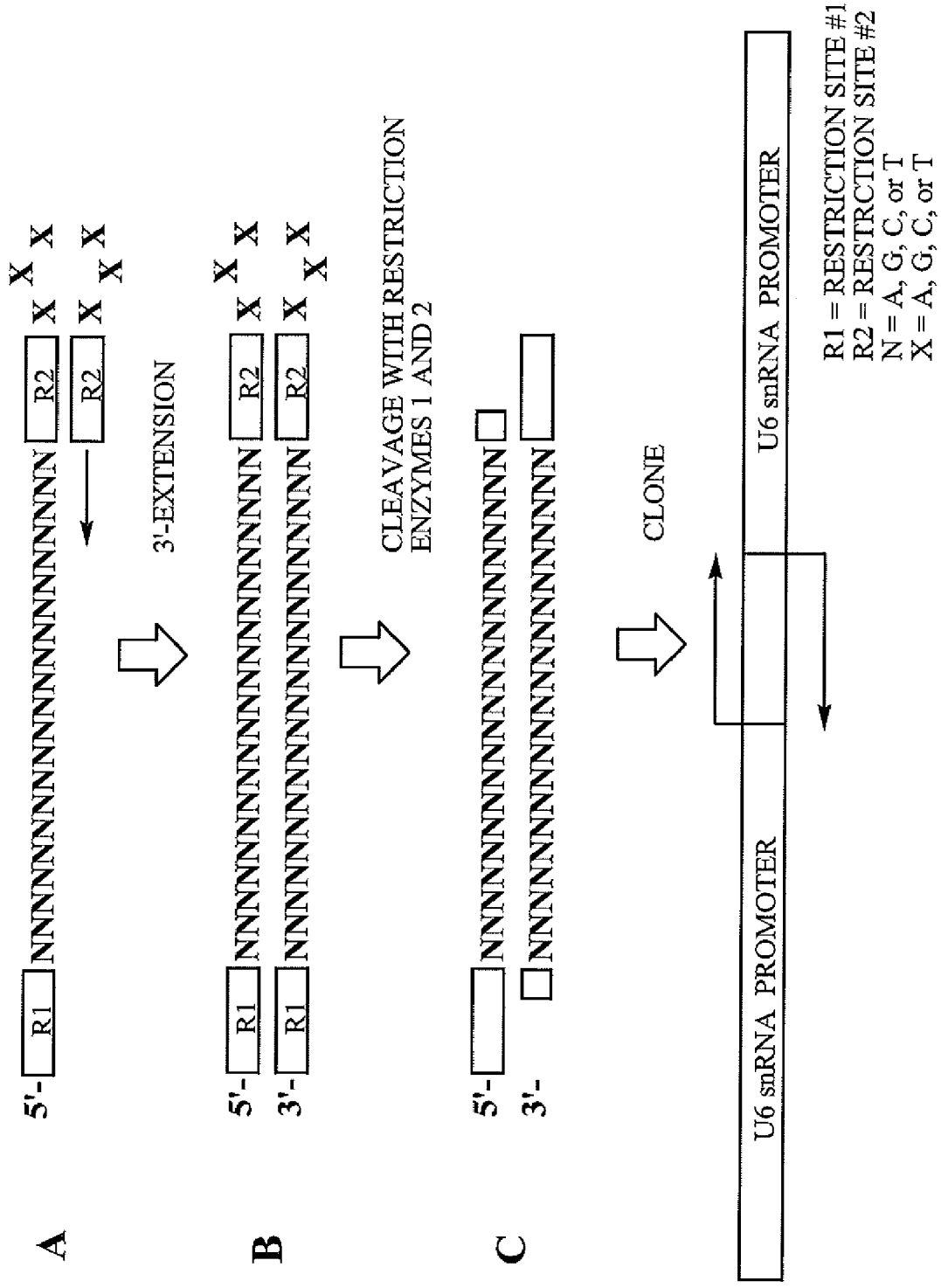

FIG. 8A-C is a diagrammatic representation of a scheme utilized in generating an expression cassette to generate double-stranded siNA constructs.

FIG. 8A: A DNA oligomer is synthesized with a 5'-restriction (R1) site sequence followed by a region having sequence identical (sense region of siNA) to a predetermined target sequence, wherein the sense region comprises, for example, about 19, 20, 21, or 22 nucleotides (N) in length, and which is followed by a 3'-restriction site (R2) which is adjacent to a loop sequence of defined sequence (X).

FIG. 8B: The synthetic construct is then extended by DNA polymerase to generate a hairpin structure having self-complementary sequence.

FIG. 8C: The construct is processed by restriction enzymes specific to R1 and R2 to generate a double-stranded DNA which is then inserted into an appropriate vector for expression in cells. The transcription cassette is designed such that a U6 promoter region flanks each side of the dsDNA which generates the separate sense and antisense strands of the siNA. Poly T termination sequences can be added to the constructs to generate U overhangs in the resulting transcript.

FIG. 9A-E is a diagrammatic representation of a method used to determine target sites for siNA mediated RNAi within a particular target nucleic acid sequence, such as messenger RNA.

FIG. 9A: A pool of siNA oligonucleotides are synthesized wherein the antisense region of the siNA constructs has complementarity to target sites across the target nucleic acid sequence, and wherein the sense region comprises sequence complementary to the antisense region of the siNA.

FIGS. 9B & C: (FIG. 9B) The sequences are pooled and are inserted into vectors such that (FIG. 9C) transfection of a vector into cells results in the expression of the siNA.

FIG. 9D: Cells are sorted based on phenotypic change that is associated with modulation of the target nucleic acid sequence.

FIG. 9E: The siNA is isolated from the sorted cells and is sequenced to identify efficacious target sites within the target nucleic acid sequence.

Figure 10:
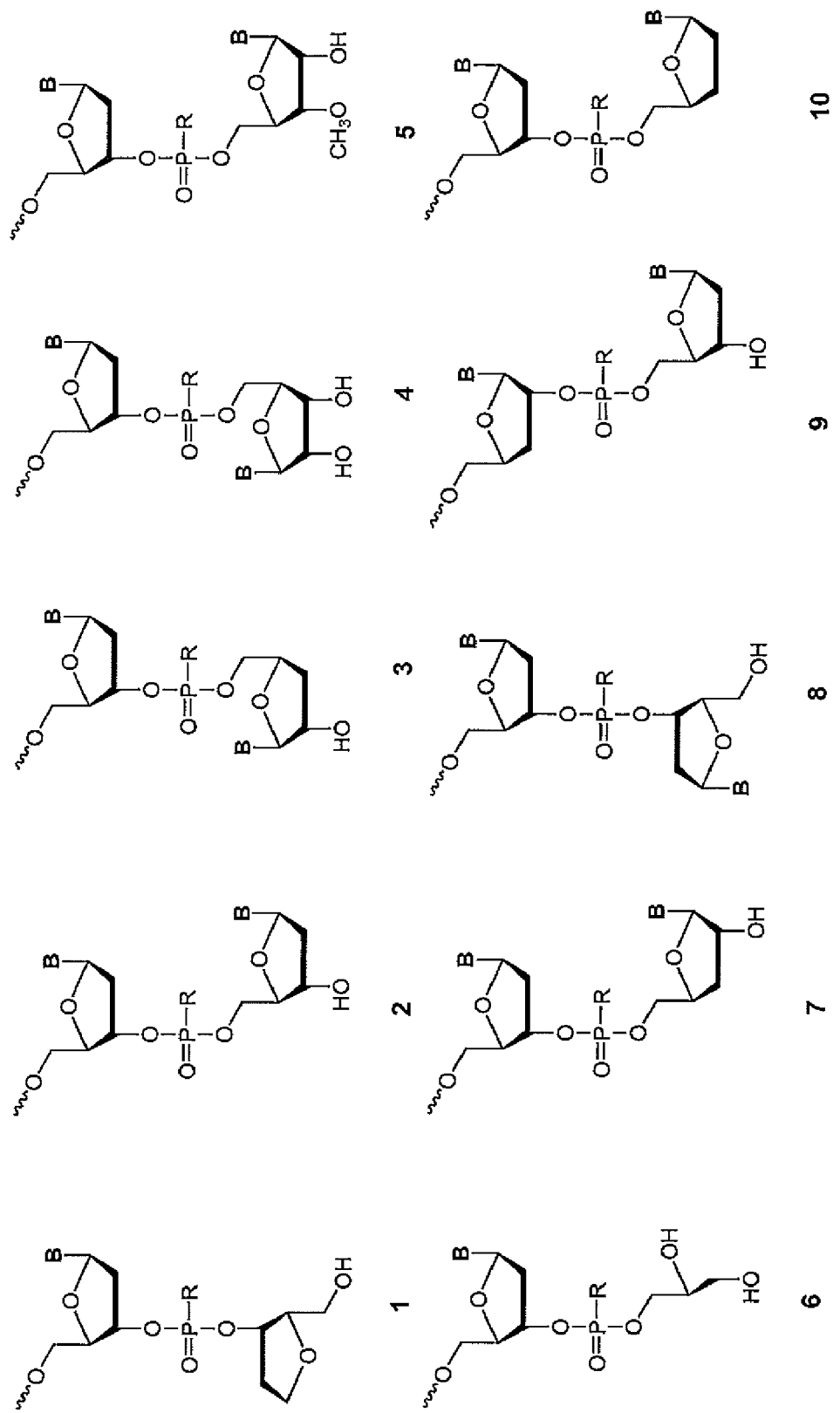

FIG. 10 shows non-limiting examples of different stabilization chemistries (1-10) that can be used, for example, to stabilize the 3'-end of siNA sequences of the invention, including (1) [3-3']-inverted deoxyribose; (2)-deoxyribonucleotide; (3) [5'-3']-3'-deoxyribonucleotide; (4) [5'-3']-ribonucleotide; (5) [5'-3']-3'-O-methyl ribonucleotide; (6) 3'-glyceryl; (7) [3'-5']-3'-deoxyribonucleotide; (8) [3'-3']-deoxyribonucleotide; (9) [5'-2']-deoxyribonucleotide; and (10) [5-3']-dideoxyribonucleotide. In addition to modified and unmodified backbone chemistries indicated in the figure, these chemistries can be combined with different backbone modifications as described herein, for example, backbone modifications having Formula I. In addition, the 2'-deoxy nucleotide shown 5' to the terminal modifications shown can be another modified or unmodified nucleotide or non-nucleotide described herein, for example modifications having any of Formulae I-VII or any combination thereof.

FIG. 11 shows a non-limiting example of a strategy used to identify chemically modified siNA constructs of the invention that are nuclease resistant while preserving the ability to mediate RNAi activity. Chemical modifications are introduced into the siNA construct based on educated design parameters (e.g. introducing 2'-modifications, base modifications, backbone modifications, terminal cap modifications etc). The modified construct in tested in an appropriate system (e.g. human serum for nuclease resistance, shown, or an animal model for PK/delivery parameters). In parallel, the siNA construct is tested for RNAi activity, for example in a cell culture system such as a luciferase reporter assay). Lead siNA constructs are then identified which possess a particular characteristic while maintaining RNAi activity, and can be further modified and assayed once again. This same approach can be used to identify siNA-conjugate molecules with improved pharmacokinetic profiles, delivery, and RNAi activity.

FIG. 12 shows non-limiting examples of phosphorylated siNA molecules of the invention, including linear and duplex constructs and asymmetric derivatives thereof.

FIG. 13 shows non-limiting examples of chemically modified terminal phosphate groups of the invention.

FIG. 14A shows a non-limiting example of methodology used to design self complementary DFO constructs utilizing palindrome and/or repeat nucleic acid sequences that are identified in a target nucleic acid sequence. (i) A palindrome or repeat sequence is identified in a nucleic acid target sequence. (ii) A sequence is designed that is complementary to the target nucleic acid sequence and the palindrome sequence. (iii) An inverse repeat sequence of the non-palindrome/repeat portion of the complementary sequence is appended to the 3'-end of the complementary sequence to generate a self complementary DFO molecule comprising sequence complementary to the nucleic acid target. (iv) The DFO molecule can self-assemble to form a double stranded oligonucleotide. FIG. 14B shows a non-limiting representative example of a duplex forming oligonucleotide sequence. FIG. 14C shows a non-limiting example of the self assembly schematic of a representative duplex forming oligonucleotide sequence. FIG. 14D shows a non-limiting example of the self assembly schematic of a representative duplex forming oligonucleotide sequence followed by interaction with a target nucleic acid sequence resulting in modulation of gene expression.

FIG. 15 shows a non-limiting example of the design of self complementary DFO constructs utilizing palindrome and/or repeat nucleic acid sequences that are incorporated into the DFO constructs that have sequence complementary to any target nucleic acid sequence of interest. Incorporation of these palindrome/repeat sequences allow the design of DFO constructs that form duplexes in which each strand is capable of mediating modulation of target gene expression, for example by RNAi. First, the target sequence is identified. A complementary sequence is then generated in which nucleotide or non-nucleotide modifications (shown as X or Y) are introduced into the complementary sequence that generate an artificial palindrome (shown as XYXYXY in the Figure). An inverse repeat of the non-palindrome/repeat complementary sequence is appended to the 3'-end of the complementary sequence to generate a self complementary DFO comprising sequence complementary to the nucleic acid target. The DFO can self-assemble to form a double stranded oligonucleotide.

FIG. 16 shows non-limiting examples of multifunctional siNA molecules of the invention comprising two separate polynucleotide sequences that are each capable of mediating RNAi directed cleavage of differing target nucleic acid sequences. FIG. 16A shows a non-limiting example of a multifunctional siNA molecule having a first region that is complementary to a first target nucleic acid sequence (complementary region 1) and a second region that is complementary to a second target nucleic acid sequence (complementary region 2), wherein the first and second complementary regions are situated at the 3'-ends of each polynucleotide sequence in the multifunctional siNA. The dashed portions of each polynucleotide sequence of the multifunctional siNA construct have complementarity with regard to corresponding portions of the siNA duplex, but do not have complementarity to the target nucleic acid sequences. FIG. 16B shows a non-limiting example of a multifunctional siNA molecule having a first region that is complementary to a first target nucleic acid sequence (complementary region 1) and a second region that is complementary to a second target nucleic acid sequence (complementary region 2), wherein the first and second complementary regions are situated at the 5'-ends of each polynucleotide sequence in the multifunctional siNA. The dashed portions of each polynucleotide sequence of the multifunctional siNA construct have complementarity with regard to corresponding portions of the siNA duplex, but do not have complementarity to the target nucleic acid sequences.

FIG. 17 shows non-limiting examples of multifunctional siNA molecules of the invention comprising a single polynucleotide sequence comprising distinct regions that are each capable of mediating RNAi directed cleavage of differing target nucleic acid sequences. FIG. 17A shows a non-limiting example of a multifunctional siNA molecule having a first region that is complementary to a first target nucleic acid sequence (complementary region 1) and a second region that is complementary to a second target nucleic acid sequence (complementary region 2), wherein the second complementary region is situated at the 3'-end of the polynucleotide sequence in the multifunctional siNA. The dashed portions of each polynucleotide sequence of the multifunctional siNA construct have complementarity with regard to corresponding portions of the siNA duplex, but do not have complementarity to the target nucleic acid sequences. FIG. 17B shows a non-limiting example of a multifunctional siNA molecule having a first region that is complementary to a first target nucleic acid sequence (complementary region 1) and a second region that is complementary to a second target nucleic acid sequence (complementary region 2), wherein the first complementary region is situated at the 5'-end of the polynucleotide sequence in the multifunctional siNA. The dashed portions of each polynucleotide sequence of the multifunctional siNA construct have complementarity with regard to corresponding portions of the siNA duplex, but do not have complementarity to the target nucleic acid sequences. In one embodiment, these multifunctional siNA constructs are processed in vivo or in vitro to generate multifunctional siNA constructs as shown in FIG. 16.

FIG. 18 shows non-limiting examples of multifunctional siNA molecules of the invention comprising two separate polynucleotide sequences that are each capable of mediating RNAi directed cleavage of differing target nucleic acid sequences and wherein the multifunctional siNA construct further comprises a self complementary, palindrome, or repeat region, thus enabling shorter bifunctional siNA constructs that can mediate RNA interference against differing target nucleic acid sequences. FIG. 18A shows a non-limiting example of a multifunctional siNA molecule having a first region that is complementary to a first target nucleic acid sequence (complementary region 1) and a second region that is complementary to a second target nucleic acid sequence (complementary region 2), wherein the first and second complementary regions are situated at the 3'-ends of each polynucleotide sequence in the multifunctional siNA, and wherein the first and second complementary regions further comprise a self complementary, palindrome, or repeat region. The dashed portions of each polynucleotide sequence of the multifunctional siNA construct have complementarity with regard to corresponding portions of the siNA duplex, but do not have complementarity to the target nucleic acid sequences. FIG. 18B shows a non-limiting example of a multifunctional siNA molecule having a first region that is complementary to a first target nucleic acid sequence (complementary region 1) and a second region that is complementary to a second target nucleic acid sequence (complementary region 2), wherein the first and second complementary regions are situated at the 5'-ends of each polynucleotide sequence in the multifunctional siNA, and wherein the first and second complementary regions further comprise a self complementary, palindrome, or repeat region. The dashed portions of each polynucleotide sequence of the multifunctional siNA construct have complementarity with regard to corresponding portions of the siNA duplex, but do not have complementarity to the target nucleic acid sequences.

FIG. 19 shows non-limiting examples of multifunctional siNA molecules of the invention comprising a single polynucleotide sequence comprising distinct regions that are each capable of mediating RNAi directed cleavage of differing target nucleic acid sequences and wherein the multifunctional siNA construct further comprises a self complementary, palindrome, or repeat region, thus enabling shorter bifunctional siNA constructs that can mediate RNA interference against differing target nucleic acid sequences. FIG. 19A shows a non-limiting example of a multifunctional siNA molecule having a first region that is complementary to a first target nucleic acid sequence (complementary region 1) and a second region that is complementary to a second target nucleic acid sequence (complementary region 2), wherein the second complementary region is situated at the 3'-end of the polynucleotide sequence in the multifunctional siNA, and wherein the first and second complementary regions further comprise a self complementary, palindrome, or repeat region. The dashed portions of each polynucleotide sequence of the multifunctional siNA construct have complementarity with regard to corresponding portions of the siNA duplex, but do not have complementarity to the target nucleic acid sequences. FIG. 19B shows a non-limiting example of a multifunctional siNA molecule having a first region that is complementary to a first target nucleic acid sequence (complementary region 1) and a second region that is complementary to a second target nucleic acid sequence (complementary region 2), wherein the first complementary region is situated at the 5'-end of the polynucleotide sequence in the multifunctional siNA, and wherein the first and second complementary regions further comprise a self complementary, palindrome, or repeat region. The dashed portions of each polynucleotide sequence of the multifunctional siNA construct have complementarity with regard to corresponding portions of the siNA duplex, but do not have complementarity to the target nucleic acid sequences. In one embodiment, these multifunctional siNA constructs are processed in vivo or in vitro to generate multifunctional siNA constructs as shown in FIG. 18.

FIG. 20 shows a non-limiting example of how multifunctional siNA molecules of the invention can target two separate target nucleic acid molecules, such as separate RNA molecules encoding differing proteins, for example, a cytokine and its corresponding receptor, differing viral strains, a virus and a cellular protein involved in viral infection or replication, or differing proteins involved in a common or divergent biologic pathway that is implicated in the maintenance of progression of disease. Each strand of the multifunctional siNA construct comprises a region having complementarity to separate target nucleic acid molecules. The multifunctional siNA molecule is designed such that each strand of the siNA can be utilized by the RISC complex to initiate RNA interference mediated cleavage of its corresponding target. These design parameters can include destabilization of each end of the siNA construct (see for example Schwarz et al., 2003, *Cell*, 115, 199-208). Such destabilization can be accomplished for example by using guanosine-cytidine base pairs, alternate base pairs (e.g., wobbles), or destabilizing chemically modified nucleotides at terminal nucleotide positions as is known in the art.

FIG. 21 shows a non-limiting example of how multifunctional siNA molecules of the invention can target two separate target nucleic acid sequences within the same target nucleic acid molecule, such as alternate coding regions of a RNA, coding and non-coding regions of a RNA, or alternate splice variant regions of a RNA. Each strand of the multifunctional siNA construct comprises a region having complementarity to the separate regions of the target nucleic acid molecule. The multifunctional siNA molecule is designed such that each strand of the siNA can be utilized by the RISC complex to initiate RNA interference mediated cleavage of its corresponding target region. These design parameters can include destabilization of each end of the siNA construct (see for example Schwarz et al., 2003, Cell, 115, 199-208). Such destabilization can be accomplished for example by using guanosine-cytidine base pairs, alternate base pairs (e.g., wobbles), or destabilizing chemically modified nucleotides at terminal nucleotide positions as is known in the art.

FIG. 22(A-H) shows non-limiting examples of tethered multifunctional siNA constructs of the invention. In the examples shown, a linker (e.g., nucleotide or non-nucleotide linker) connects two siNA regions (e.g., two sense, two antisense, or alternately a sense and an antisense region together. Separate sense (or sense and antisense) sequences corresponding to a first target sequence and second target sequence are hybridized to their corresponding sense and/or antisense sequences in the multifunctional siNA. In addition, various conjugates, ligands, aptamers, polymers or reporter molecules can be attached to the linker region for selective or improved delivery and/or pharmacokinetic properties.

FIG. 23 shows a non-limiting example of various dendrimer based multifunctional siNA designs.

FIG. 24 shows a non-limiting example of various supramolecular multifunctional siNA designs.

FIG. 25 shows a non-limiting example of a dicer enabled multifunctional siNA design using a 30 nucleotide precursor siNA construct. A 30 base pair duplex is cleaved by Dicer into 22 and 8 base pair products from either end (8 b.p. fragments not shown). For ease of presentation the overhangs generated by dicer are not shown—but can be compensated for. Three targeting sequences are shown. The required sequence identity overlapped is indicated by grey boxes. The N's of the parent 30 b.p. siNA are suggested sites of 2'-OH positions to enable Dicer cleavage if this is tested in stabilized chemistries. Note that processing of a 30mer duplex by Dicer RNase III does not give a precise 22+8 cleavage, but rather produces a series of closely related products (with 22+8 being the primary site). Therefore, processing by Dicer will yield a series of active siNAs.

FIG. 26 shows a non-limiting example of a dicer enabled multifunctional siNA design using a 40 nucleotide precursor siNA construct. A 40 base pair duplex is cleaved by Dicer into 20 base pair products from either end. For ease of presentation the overhangs generated by dicer are not shown—but can be compensated for. Four targeting sequences are shown. The target sequences having homology are enclosed by boxes. This design format can be extended to larger RNAs. If chemically stabilized siNAs are bound by Dicer, then strategically located ribonucleotide linkages can enable designer cleavage products that permit our more extensive repertoire of multifunctional designs. For example cleavage products not limited to the Dicer standard of approximately 22-nucleotides can allow multifunctional siNA constructs with a target sequence identity overlap ranging from, for example, about 3 to about 15 nucleotides.

FIG. 27 shows a non-limiting example of additional multifunctional siNA construct designs of the invention. In one example, a conjugate, ligand, aptamer, lable, or other moiety is attached to a region of the multifunctional siNA to enable improved delivery or pharmacokinetic profiling.

FIG. 28 shows a non-limiting example of additional multifunctional siNA construct designs of the invention. In one example, a conjugate, ligand, aptamer, lable, or other moiety is attached to a region of the multifunctional siNA to enable improved delivery or pharmacokinetic profiling.

FIG. 29 shows a non-limiting example of a cholesterol linked phosphoramidite that can be used to synthesize cholesterol conjugated siNA molecules of the invention. An example is shown with the cholesterol moiety linked to the 5'-end of the sense strand of a siNA molecule.

FIG. 30 shows a non-limiting example of a double stranded nucleic acid molecule cocktail formulation targeting GBV-B in a marmoset model of HCV infection. GBV-B provides a small animal model for testing antiviral compounds and vaccines for HCV infection. Two animals were inoculated with GBV-B and IV treatment with the active formulated siNA (Sirna Compound Nos. 33149/47677 and 31703/38756, Formulation LNP-086; see Tables III and VI) at 3 mg/kg was initiated one day post infection. Another 2 animals were inoculated with GBV-B and were untreated to serve as negative controls. The animals were monitored to determine the effect of the therapy of GBV-B infection. Blood draws were performed over the course of the study to determine viral titers. Dosing of formulated siNA in the treated animals was repeated at days 1, 3, and 7 after inoculation at day 0. As shown in the figure, these animals show a profound inhibition of GBV-B over a three week time course compared to the untreated control animals.

FIG. 31 shows a non-limiting example of inhibition of GBV infection in an animal with established GBV infection that was treated with active formulated siNA (Sirna Compound Nos. 33149/47677 and 31703/38756, Formulation LNP-086; see Tables III and VI) at days 28, 31, and 35 post infection. This animal showed a decrease in viral titer down to the limit of detection following the dosing of active compound compared to historic untreated controls.

DETAILED DESCRIPTION OF THE INVENTION

Mechanism of Action of Nucleic Acid Molecules of the Invention

The discussion that follows discusses the proposed mechanism of RNA interference mediated by short interfering RNA as is presently known, and is not meant to be limiting and is not an admission of prior art. Applicant demonstrates herein that chemically-modified short interfering nucleic acids possess similar or improved capacity to mediate RNAi as do siRNA molecules and are expected to possess improved stability and activity in vivo; therefore, this discussion is not meant to be limiting only to siRNA and can be applied to siNA as a whole. By "improved capacity to mediate RNAi" or "improved RNAi activity" is meant to include RNAi activity measured in vitro and/or in vivo where the RNAi activity is a reflection of both the ability of the siNA to mediate RNAi and the stability of the siNAs of the invention. In this invention, the product of these activities can be increased in vitro and/or in vivo compared to an all RNA siRNA or a siNA containing a plurality of ribonucleotides. In some cases, the activity or stability of the siNA molecule can be decreased (i.e., less than ten-fold), but the overall activity of the siNA molecule is enhanced in vitro and/or in vivo.

RNA interference refers to the process of sequence specific post-transcriptional gene silencing in animals mediated by short interfering RNAs (siRNAs) (Fire et al., 1998, Nature, 391, 806). The corresponding process in plants is commonly referred to as post-transcriptional gene silencing or RNA silencing and is also referred to as quelling in fungi. The process of post-transcriptional gene silencing is thought to be an evolutionarily-conserved cellular defense mechanism used to prevent the expression of foreign genes which is commonly shared by diverse flora and phyla (Fire et al., 1999, *Trends Genet.*, 15, 358). Such protection from foreign gene expression may have evolved in response to the production of double-stranded RNAs (dsRNAs) derived from viral infection or the random integration of transposon elements into a host genome via a cellular response that specifically destroys homologous single-stranded RNA or viral genomic RNA. The presence of dsRNA in cells triggers the RNAi response though a mechanism that has yet to be fully characterized. This mechanism appears to be different from the interferon response that results from dsRNA-mediated activation of protein kinase PKR and 2',5'-oligoadenylate synthetase resulting in non-specific cleavage of mRNA by ribonuclease L.

The presence of long dsRNAs in cells stimulates the activity of a ribonuclease III enzyme referred to as Dicer. Dicer is involved in the processing of the dsRNA into short pieces of dsRNA known as short interfering RNAs (siRNAs) (Berstein et al., 2001, *Nature*, 409, 363). Short interfering RNAs derived from Dicer activity are typically about 21 to about 23 nucleotides in length and comprise about 19 base pair duplexes. Dicer has also been implicated in the excision of 21- and 22-nucleotide small temporal RNAs (stRNAs) from precursor RNA of conserved structure that are implicated in translational control (Hutvagner et al., 2001, *Science*, 293, 834). The RNAi response also features an endonuclease complex containing a siRNA, commonly referred to as an RNA-induced silencing complex (RISC), which mediates cleavage of single-stranded RNA having sequence homologous to the siRNA. Cleavage of the target RNA takes place in the middle of the region complementary to the guide sequence of the siRNA duplex (Elbashir et al., 2001, *Genes Dev.*, 15, 188). In addition, RNA interference can also involve small RNA (e.g., micro-RNA or miRNA) mediated gene silencing, presumably though cellular mechanisms that regulate chromatin structure and thereby prevent transcription of target gene sequences (see for example Allshire, 2002, *Science*, 297, 1818-1819; Volpe et al., 2002, *Science*, 297, 1833-1837; Jenuwein, 2002, *Science*, 297, 2215-2218; and Hall et al., 2002, *Science*, 297, 2232-2237). As such, siNA molecules of the invention can be used to mediate gene silencing via interaction with RNA transcripts or alternately by interaction with particular gene sequences, wherein such interaction results in gene silencing either at the transcriptional level or post-transcriptional level.

RNAi has been studied in a variety of systems. Fire et al., 1998, *Nature*, 391, 806, were the first to observe RNAi in *C. elegans*. Wianny and Goetz, 1999, *Nature Cell Biol.*, 2, 70, describe RNAi mediated by dsRNA in mouse embryos. Hammond et al., 2000, *Nature*, 404, 293, describe RNAi in *Drosophila* cells transfected with dsRNA. Elbashir et al., 2001, *Nature*, 411, 494, describe RNAi induced by introduction of duplexes of synthetic 21-nucleotide RNAs in cultured mammalian cells including human embryonic kidney and HeLa cells. Recent work in *Drosophila* embryonic lysates has revealed certain requirements for siRNA length, structure, chemical composition, and sequence that are essential to mediate efficient RNAi activity. These studies have shown that 21 nucleotide siRNA duplexes are most active when containing two 2-nucleotide 3'-terminal nucleotide overhangs. Furthermore, substitution of one or both siRNA strands with 2'-deoxy or 2'-O-methyl nucleotides abolishes RNAi activity, whereas substitution of 3'-terminal siRNA nucleotides with deoxy nucleotides was shown to be tolerated. Mismatch sequences in the center of the siRNA duplex were also shown to abolish RNAi activity. In addition, these studies also indicate that the position of the cleavage site in the target RNA is defined by the 5'-end of the siRNA guide sequence rather than the 3'-end (Elbashir et al., 2001, *EMBO J.*, 20, 6877). Other studies have indicated that a 5'-phosphate on the target-complementary strand of a siRNA duplex is required for siRNA activity and that ATP is utilized to maintain the 5'-phosphate moiety on the siRNA (Nykanen et al., 2001, *Cell*, 107, 309); however, siRNA molecules lacking a 5'-phosphate are active when introduced exogenously, suggesting that 5'-phosphorylation of siRNA constructs may occur in vivo.

Duplex Forming Oligonucleotides (DFO) of the Invention

In one embodiment, the invention features siNA molecules comprising duplex forming oligonucleotides (DFO) that can self-assemble into double stranded oligonucleotides. The duplex forming oligonucleotides of the invention can be chemically synthesized or expressed from transcription units and/or vectors. The DFO molecules of the instant invention provide useful reagents and methods for a variety of therapeutic, diagnostic, agricultural, veterinary, target validation, genomic discovery, genetic engineering and pharmacogenomic applications.

Applicant demonstrates herein that certain oligonucleotides, referred to herein for convenience but not limitation as duplex forming oligonucleotides or DFO molecules, are potent mediators of sequence specific regulation of gene expression. The oligonucleotides of the invention are distinct from other nucleic acid sequences known in the art (e.g., siRNA, miRNA, stRNA, shRNA, antisense oligonucleotides etc.) in that they represent a class of linear polynucleotide sequences that are designed to self-assemble into double stranded oligonucleotides, where each strand in the double stranded oligonucleotides comprises a nucleotide sequence that is complementary to a target nucleic acid molecule. Nucleic acid molecules of the invention can thus self assemble into functional duplexes in which each strand of the duplex comprises the same polynucleotide sequence and each strand comprises a nucleotide sequence that is complementary to a target nucleic acid molecule.

Generally, double stranded oligonucleotides are formed by the assembly of two distinct oligonucleotide sequences where the oligonucleotide sequence of one strand is complementary to the oligonucleotide sequence of the second strand; such double stranded oligonucleotides are assembled from two separate oligonucleotides, or from a single molecule that folds on itself to form a double stranded structure, often referred to in the field as hairpin stem-loop structure (e.g., shRNA or short hairpin RNA). These double stranded oligonucleotides known in the art all have a common feature in that each strand of the duplex has a distinct nucleotide sequence.

Distinct from the double stranded nucleic acid molecules known in the art, the applicants have developed a novel, potentially cost effective and simplified method of forming a double stranded nucleic acid molecule starting from a single stranded or linear oligonucleotide. The two strands of the double stranded oligonucleotide formed according to the instant invention have the same nucleotide sequence and are not covalently linked to each other. Such double-stranded oligonucleotides molecules can be readily linked post-synthetically by methods and reagents known in the art and are within the scope of the invention. In one embodiment, the single stranded oligonucleotide of the invention (the duplex forming oligonucleotide) that forms a double stranded oligonucleotide comprises a first region and a second region, where the second region includes a nucleotide sequence that is an inverted repeat of the nucleotide sequence in the first region, or a portion thereof, such that the single stranded oligonucleotide self assembles to form a duplex oligonucleotide in which the nucleotide sequence of one strand of the duplex is the same as the nucleotide sequence of the second strand. Non-limiting examples of such duplex forming oligonucleotides are illustrated in FIGS. 14 and 15. These duplex forming oligonucleotides (DFOs) can optionally include certain palindrome or repeat sequences where such palindrome or repeat sequences are present in between the first region and the second region of the DFO.

In one embodiment, the invention features a duplex forming oligonucleotide (DFO) molecule, wherein the DFO comprises a duplex forming self complementary nucleic acid sequence that has nucleotide sequence complementary to a target nucleic acid sequence. The DFO molecule can comprise a single self complementary sequence or a duplex resulting from assembly of such self complementary sequences.

In one embodiment, a duplex forming oligonucleotide (DFO) of the invention comprises a first region and a second region, wherein the second region comprises a nucleotide sequence comprising an inverted repeat of nucleotide sequence of the first region such that the DFO molecule can assemble into a double stranded oligonucleotide. Such double stranded oligonucleotides can act as a short interfering nucleic acid (siNA) to modulate gene expression. Each strand of the double stranded oligonucleotide duplex formed by DFO molecules of the invention can comprise a nucleotide sequence region that is complementary to the same nucleotide sequence in a target nucleic acid molecule (e.g., HCV target RNA).

In one embodiment, the invention features a single stranded DFO that can assemble into a double stranded oligonucleotide. The applicant has surprisingly found that a single stranded oligonucleotide with nucleotide regions of self complementarity can readily assemble into duplex oligonucleotide constructs. Such DFOs can assemble into duplexes that can inhibit gene expression in a sequence specific manner. The DFO molecules of the invention comprise a first region with nucleotide sequence that is complementary to the nucleotide sequence of a second region and where the sequence of the first region is complementary to a target nucleic acid. The DFO can form a double stranded oligonucleotide wherein a portion of each strand of the double stranded oligonucleotide comprises a sequence complementary to a target nucleic acid sequence.

In one embodiment, the invention features a double stranded oligonucleotide, wherein the two strands of the double stranded oligonucleotide are not covalently linked to each other, and wherein each strand of the double stranded oligonucleotide comprises a nucleotide sequence that is complementary to the same nucleotide sequence in a target nucleic acid molecule or a portion thereof (e.g., HCV RNA target). In another embodiment, the two strands of the double stranded oligonucleotide share an identical nucleotide sequence of at least about 15, preferably at least about 16, 17, 18, 19, 20, or 21 nucleotides.

In one embodiment, a DFO molecule of the invention comprises a structure having Formula DFO-I:

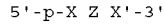

wherein Z comprises a palindromic or repeat nucleic acid sequence optionally with one or more modified nucleotides (e.g., nucleotide with a modified base, such as 2-amino purine, 2-amino-1,6-dihydro purine or a universal base), for example of length about 2 to about 24 nucleotides in even numbers (e.g., about 2, 4, 6, 8, 10, 12, 14, 16, 18, 20, or 22 or 24 nucleotides), X represents a nucleic acid sequence, for example of length of about 1 to about 21 nucleotides (e.g., about 1, 2, 3, 4, 5, 6, 7, 8, 9, 10, 11, 12, 13, 14, 15, 16, 17, 18, 19, 20; or 21 nucleotides), X' comprises a nucleic acid sequence, for example of length about 1 and about 21 nucleotides (e.g., about 1, 2, 3, 4, 5, 6, 7, 8, 9, 10, 11, 12, 13, 14, 15, 16, 17, 18, 19, 20 or 21 nucleotides) having nucleotide sequence complementarity to sequence X or a portion thereof, p comprises a terminal phosphate group that can be present or absent, and wherein sequence X and Z, either independently or together, comprise nucleotide sequence that is complementary to a target nucleic acid sequence or a portion thereof and is of length sufficient to interact (e.g., base pair) with the target nucleic acid sequence or a portion thereof (e.g., HCV RNA target). For example, X independently can comprise a sequence from about 12 to about 21 or more (e.g., about 12, 13, 14, 15, 16, 17, 18, 19, 20, 21, or more) nucleotides in length that is complementary to nucleotide sequence in a target RNA or a portion thereof. In another non-limiting example, the length of the nucleotide sequence of X and Z together, when X is present, that is complementary to the target RNA or a portion thereof (e.g., HCV RNA target) is from about 12 to about 21 or more nucleotides (e.g., about 12, 13, 14, 15, 16, 17, 18, 19, 20, 21, or more). In yet another non-limiting example, when X is absent, the length of the nucleotide sequence of Z that is complementary to the target RNA or a portion thereof is from about 12 to about 24 or more nucleotides (e.g., about 12, 14, 16, 18, 20, 22, 24, or more). In one embodiment X, Z and X' are independently oligonucleotides, where X and/or Z comprises a nucleotide sequence of length sufficient to interact (e.g., base pair) with a nucleotide sequence in the target RNA or a portion thereof (e.g., HCV RNA target). In one embodiment, the lengths of oligonucleotides X and X' are identical. In another embodiment, the lengths of oligonucleotides X and X' are not identical. In another embodiment, the lengths of oligonucleotides X and Z, or Z and X', or X, Z and X' are either identical or different.

When a sequence is described in this specification as being of "sufficient" length to interact (i.e., base pair) with another sequence, it is meant that the length is such that the number of bonds (e.g., hydrogen bonds) formed between the two sequences is enough to enable the two sequence to form a duplex under the conditions of interest. Such conditions can be in vitro (e.g., for diagnostic or assay purposes) or in vivo (e.g., for therapeutic purposes). It is a simple and routine matter to determine such lengths.

In one embodiment, the invention features a double stranded oligonucleotide construct having Formula DFO-I (a):

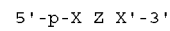

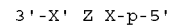

wherein Z comprises a palindromic or repeat nucleic acid sequence or palindromic or repeat-like nucleic acid sequence with one or more modified nucleotides (e.g., nucleotides with a modified base, such as 2-amino purine, 2-amino-1,6-dihydro purine or a universal base), for example of length about 2 to about 24 nucleotides in even numbers (e.g., about 2, 4, 6, 8, 10, 12, 14, 16, 18, 20, 22 or 24 nucleotides), X represents a nucleic acid sequence, for example of length about 1 to about 21 nucleotides (e.g., about 1, 2, 3, 4, 5, 6, 7, 8, 9, 10, 11, 12, 13, 14, 15, 16, 17, 18, 19, 20, or 21 nucleotides), X' comprises a nucleic acid sequence, for example of length about 1 to about 21 nucleotides (e.g., about 1, 2, 3, 4, 5, 6, 7, 8, 9, 10, 11, 12, 13, 14, 15, 16, 17, 18, 19, 20 or 21 nucleotides) having nucleotide sequence complementarity to sequence X or a portion thereof, p comprises a terminal phosphate group that can be present or absent, and wherein each X and Z independently comprises a nucleotide sequence that is complementary to a target nucleic acid sequence or a portion thereof (e.g., HCV RNA target) and is of length sufficient to interact with the target nucleic acid sequence of a portion thereof (e.g., HCV RNA target). For example, sequence X independently can comprise a sequence from about 12 to about 21 or more nucleotides (e.g., about 12, 13, 14, 15, 16, 17, 18, 19, 20, 21, or more) in length that is complementary to a nucleotide sequence in a target RNA or a portion thereof (e.g., HCV RNA target). In another non-limiting example, the length of the nucleotide sequence of X and Z together (when X is present) that is complementary to the target RNA or a portion thereof is from about 12 to about 21 or more nucleotides (e.g., about 12, 13, 14, 15, 16, 17, 18, 19, 20, 21, or more). In yet another non-limiting example, when X is absent, the length of the nucleotide sequence of Z that is complementary to the target RNA or a portion thereof is from about 12 to about 24 or more nucleotides (e.g., about 12, 14, 16, 18, 20, 22, 24 or more). In one embodiment X, Z and X' are independently oligonucleotides, where X and/or Z comprises a nucleotide sequence of length sufficient to interact (e.g., base pair) with nucleotide sequence in the target RNA or a portion thereof (e.g., HCV RNA target). In one embodiment, the lengths of oligonucleotides X and X' are identical. In another embodiment, the lengths of oligonucleotides X and X' are not identical. In another embodiment, the lengths of oligonucleotides X and Z or Z and X' or X, Z and X' are either identical or different. In one embodiment, the double stranded oligonucleotide construct of Formula I(a) includes one or more, specifically 1, 2, 3 or 4, mismatches, to the extent such mismatches do not significantly diminish the ability of the double stranded oligonucleotide to inhibit target gene expression.

In one embodiment, a DFO molecule of the invention comprises structure having Formula DFO-II:

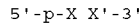

wherein each X and X' are independently oligonucleotides of length about 12 nucleotides to about 21 nucleotides, wherein X comprises, for example, a nucleic acid sequence of length about 12 to about 21 nucleotides (e.g., about 12, 13, 14, 15, 16, 17, 18, 19, 20 or 21 nucleotides), X' comprises a nucleic acid sequence, for example of length about 12 to about 21 nucleotides (e.g., about 12, 13, 14, 15, 16, 17, 18, 19, 20, or 21 nucleotides) having nucleotide sequence complementarity to sequence X or a portion thereof, p comprises a terminal phosphate group that can be present or absent, and wherein X comprises a nucleotide sequence that is complementary to a HCV target nucleic acid sequence (e.g., HCV target RNA) or a portion thereof and is of length sufficient to interact (e.g., base pair) with the HCV target nucleic acid sequence of a portion thereof. In one embodiment, the length of oligonucleotides X and X' are identical. In another embodiment the length of oligonucleotides X and X' are not identical. In one embodiment, length of the oligonucleotides X and X' are sufficient to form a relatively stable double stranded oligonucleotide.

In one embodiment, the invention features a double stranded oligonucleotide construct having Formula DFO-II (a):

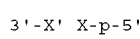

wherein each X and X' are independently oligonucleotides of length about 12 nucleotides to about 21 nucleotides, wherein X comprises a nucleic acid sequence, for example of length about 12 to about 21 nucleotides (e.g., about 12, 13, 14, 15, 16, 17, 18, 19, 20 or 21 nucleotides), X' comprises a nucleic acid sequence, for example of length about 12 to about 21 nucleotides (e.g., about 12, 13, 14, 15, 16, 17, 18, 19, 20 or 21 nucleotides) having nucleotide sequence complementarity to sequence X or a portion thereof, p comprises a terminal phosphate group that can be present or absent, and wherein X comprises nucleotide sequence that is complementary to a HCV target nucleic acid sequence or a portion thereof (e.g., HCV RNA target) and is of length sufficient to interact (e.g., base pair) with the target nucleic acid sequence (e.g., target RNA) or a portion thereof. In one embodiment, the lengths of oligonucleotides X and X' are identical. In another embodiment, the lengths of oligonucleotides X and X' are not identical. In one embodiment, the lengths of the oligonucleotides X and X' are sufficient to form a relatively stable double stranded oligonucleotide. In one embodiment, the double stranded oligonucleotide construct of Formula II(a) includes one or more, specifically 1, 2, 3 or 4, mismatches, to the extent such mismatches do not significantly diminish the ability of the double stranded oligonucleotide to inhibit target gene expression.

In one embodiment, the invention features a DFO molecule having Formula DFO-I(b):

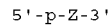

where Z comprises a palindromic or repeat nucleic acid sequence optionally including one or more non-standard or modified nucleotides (e.g., nucleotide with a modified base, such as 2-amino purine or a universal base) that can facilitate base-pairing with other nucleotides. Z can be, for example, of length sufficient to interact (e.g., base pair) with nucleotide sequence of a target nucleic acid (e.g., target RNA) molecule, preferably of length of at least 12 nucleotides, specifically about 12 to about 24 nucleotides (e.g., about 12, 14, 16, 18, 20, 22 or 24 nucleotides). p represents a terminal phosphate group that can be present or absent.

In one embodiment, a DFO molecule having any of Formula DFO-I, DFO-I(a), DFO-I(b), DFO-II(a) or DFO-II can comprise chemical modifications as described herein without limitation, such as, for example, nucleotides having any of Formulae I-VII, stabilization chemistries as described in Table IV, or any other combination of modified nucleotides and non-nucleotides as described in the various embodiments herein.

In one embodiment, the palindrome or repeat sequence or modified nucleotide (e.g., nucleotide with a modified base, such as 2-amino purine or a universal base) in Z of DFO constructs having Formula DFO-I, DFO-I(a) and DFO-I(b), comprises chemically modified nucleotides that are able to interact with a portion of the HCV target nucleic acid sequence (e.g., modified base analogs that can form Watson Crick base pairs or non-Watson Crick base pairs).

In one embodiment, a DFO molecule of the invention, for example a DFO having Formula DFO-I or DFO-II, comprises about 15 to about 40 nucleotides (e.g., about 15, 16, 17, 18, 19, 20, 21, 22, 23, 24, 25, 26, 27, 28, 29, 30, 31, 32, 33, 34, 35, 36, 37, 38, 39, or 40 nucleotides). In one embodiment, a DFO molecule of the invention comprises one or more chemical modifications. In a non-limiting example, the introduction of chemically modified nucleotides and/or non-nucleotides into nucleic acid molecules of the invention provides a powerful tool in overcoming potential limitations of in vivo stability and bioavailability inherent to unmodified RNA molecules that are delivered exogenously. For example, the use of chemically modified nucleic acid molecules can enable a lower dose of a particular nucleic acid molecule for a given therapeutic effect since chemically modified nucleic acid molecules tend to have a longer half-life in serum or in cells or tissues. Furthermore, certain chemical modifications can improve the bioavailability and/or potency of nucleic acid molecules by not only enhancing half-life but also facilitating the targeting of nucleic acid molecules to particular organs, cells or tissues and/or improving cellular uptake of the nucleic acid molecules. Therefore, even if the activity of a chemically modified nucleic acid molecule is reduced in vitro as compared to a native/unmodified nucleic acid molecule, for example when compared to an unmodified RNA molecule, the overall activity of the modified nucleic acid molecule can be greater than the native or unmodified nucleic acid molecule due to improved stability, potency, duration of effect, bioavailability and/or delivery of the molecule.

Multifunctional or Multi-Targeted siNA Molecules of the Invention

In one embodiment, the invention features siNA molecules comprising multifunctional short interfering nucleic acid (multifunctional siNA) molecules that modulate the expression of one or more genes in a biologic system, such as a cell, tissue, or organism. The multifunctional short interfering nucleic acid (multifunctional siNA) molecules of the invention can target more than one region of the HCV or cellular/host target nucleic acid sequence or can target sequences of more than one distinct target nucleic acid molecules (e.g., HCV RNA or cellular/host RNA targets). The multifunctional siNA molecules of the invention can be chemically synthesized or expressed from transcription units and/or vectors. The multifunctional siNA molecules of the instant invention provide useful reagents and methods for a variety of human applications, therapeutic, diagnostic, agricultural, veterinary, target validation, genomic discovery, genetic engineering and pharmacogenomic applications.

Applicant demonstrates herein that certain oligonucleotides, referred to herein for convenience but not limitation as multifunctional short interfering nucleic acid or multifunctional siNA molecules, are potent mediators of sequence specific regulation of gene expression. The multifunctional siNA molecules of the invention are distinct from other nucleic acid sequences known in the art (e.g., siRNA, miRNA, stRNA, shRNA, antisense oligonucleotides, etc.) in that they represent a class of polynucleotide molecules that are designed such that each strand in the multifunctional siNA construct comprises a nucleotide sequence that is complementary to a distinct nucleic acid sequence in one or more target nucleic acid molecules. A single multifunctional siNA molecule (generally a double-stranded molecule) of the invention can thus target more than one (e.g., 2, 3, 4, 5, or more) differing target nucleic acid target molecules. Nucleic acid molecules of the invention can also target more than one (e.g., 2, 3, 4, 5, or more) region of the same target nucleic acid sequence. As such multifunctional siNA molecules of the invention are useful in down regulating or inhibiting the expression of one or more target nucleic acid molecules. For example, a multifunctional siNA molecule of the invention can target nucleic acid molecules encoding a virus or viral proteins and corresponding cellular proteins required for viral infection and/or replication, or differing strains of a particular virus (e.g., HCV). By reducing or inhibiting expression of more than one target nucleic acid molecule with one multifunctional siNA construct, multifunctional siNA molecules of the invention represent a class of potent therapeutic agents that can provide simultaneous inhibition of multiple targets within a disease or pathogen related pathway. Such simultaneous inhibition can provide synergistic therapeutic treatment strategies without the need for separate preclinical and clinical development efforts or complex regulatory approval process.

Use of multifunctional siNA molecules that target more then one region of a target nucleic acid molecule (e.g., messenger RNA or HCV RNA) is expected to provide potent inhibition of gene expression. For example, a single multifunctional siNA construct of the invention can target both conserved and variable regions of a target nucleic acid molecule (e.g., HCV RNA), thereby allowing down regulation or inhibition of different strain variants or a virus, or splice variants encoded by a single host gene, or allowing for targeting of both coding and non-coding regions of the host target nucleic acid molecule.

Generally, double stranded oligonucleotides are formed by the assembly of two distinct oligonucleotides where the oligonucleotide sequence of one strand is complementary to the oligonucleotide sequence of the second strand; such double stranded oligonucleotides are generally assembled from two separate oligonucleotides (e.g., siRNA). Alternately, a duplex can be formed from a single molecule that folds on itself (e.g., shRNA or short hairpin RNA). These double stranded oligonucleotides are known in the art to mediate RNA interference and all have a common feature wherein only one nucleotide sequence region (guide sequence or the antisense sequence) has complementarity to a target nucleic acid sequence, and the other strand (sense sequence) comprises nucleotide sequence that is homologous to the target nucleic acid sequence. Generally, the antisense sequence is retained in the active RISC complex and guides the RISC to the target nucleotide sequence by means of complementary base-pairing of the antisense sequence with the target sequence for mediating sequence-specific RNA interference. It is known in the art that in some cell culture systems, certain types of unmodified siRNAs can exhibit "off target" effects. It is hypothesized that this off-target effect involves the participation of the sense sequence instead of the antisense sequence of the siRNA in the RISC complex (see for example Schwarz et al., 2003, Cell, 115, 199-208). In this instance the sense sequence is believed to direct the RISC complex to a sequence (off-target sequence) that is distinct from the intended target sequence, resulting in the inhibition of the off-target sequence. In these double stranded nucleic acid molecules, each strand is complementary to a distinct target nucleic acid sequence. However, the off-targets that are affected by these dsRNAs are not entirely predictable and are non-specific.

Distinct from the double stranded nucleic acid molecules known in the art, the applicants have developed a novel, potentially cost effective and simplified method of down regulating or inhibiting the expression of more than one target nucleic acid sequence using a single multifunctional siNA construct. The multifunctional siNA molecules of the invention are designed to be double-stranded or partially double stranded, such that a portion of each strand or region of the multifunctional siNA is complementary to a target nucleic acid sequence of choice. As such, the multifunctional siNA molecules of the invention are not limited to targeting sequences that are complementary to each other, but rather to any two differing target nucleic acid sequences. Multifunctional siNA molecules of the invention are designed such that each strand or region of the multifunctional siNA molecule, that is complementary to a given target nucleic acid sequence, is of suitable length (e.g., from about 16 to about 28 nucleotides in length, preferably from about 18 to about 28 nucleotides in length) for mediating RNA interference against the target nucleic acid sequence. The complementarity between the target nucleic acid sequence and a strand or region of the multifunctional siNA must be sufficient (at least about 8 base pairs) for cleavage of the target nucleic acid sequence by RNA interference. multifunctional siNA of the invention is expected to minimize off-target effects seen with certain siRNA sequences, such as those described in (Schwarz et al., supra).

It has been reported that dsRNAs of length between 29 base pairs and 36 base pairs (Tuschl et al., International PCT Publication No. WO 02/44321) do not mediate RNAi. One reason these dsRNAs are inactive may be the lack of turnover or dissociation of the strand that interacts with the target RNA sequence, such that the RISC complex is not able to efficiently interact with multiple copies of the target RNA resulting in a significant decrease in the potency and efficiency of the RNAi process. Applicant has surprisingly found that the multifunctional siNAs of the invention can overcome this hurdle and are capable of enhancing the efficiency and potency of RNAi process. As such, in certain embodiments of the invention, multifunctional siNAs of length of about 29 to about 36 base pairs can be designed such that, a portion of each strand of the multifunctional siNA molecule comprises a nucleotide sequence region that is complementary to a target nucleic acid of length sufficient to mediate RNAi efficiently (e.g., about 15 to about 23 base pairs) and a nucleotide sequence region that is not complementary to the target nucleic acid. By having both complementary and non-complementary portions in each strand of the multifunctional siNA, the multifunctional siNA can mediate RNA interference against a target nucleic acid sequence without being prohibitive to turnover or dissociation (e.g., where the length of each strand is too long to mediate RNAi against the respective target nucleic acid sequence). Furthermore, design of multifunctional siNA molecules of the invention with internal overlapping regions allows the multifunctional siNA molecules to be of favorable (decreased) size for mediating RNA interference and of size that is well suited for use as a therapeutic agent (e.g., wherein each strand is independently from about 18 to about 28 nucleotides in length). Non-limiting examples are illustrated in FIGS. 16-28.

In one embodiment, a multifunctional siNA molecule of the invention comprises a first region and a second region, where the first region of the multifunctional siNA comprises a nucleotide sequence complementary to a nucleic acid sequence of a first target nucleic acid molecule, and the second region of the multifunctional siNA comprises nucleic acid sequence complementary to a nucleic acid sequence of a second target nucleic acid molecule. In one embodiment, a multifunctional siNA molecule of the invention comprises a first region and a second region, where the first region of the multifunctional siNA comprises nucleotide sequence complementary to a nucleic acid sequence of the first region of a target nucleic acid molecule, and the second region of the multifunctional siNA comprises nucleotide sequence complementary to a nucleic acid sequence of a second region of a the target nucleic acid molecule. In another embodiment, the first region and second region of the multifunctional siNA can comprise separate nucleic acid sequences that share some degree of complementarity (e.g., from about 1 to about 10 complementary nucleotides). In certain embodiments, multifunctional siNA constructs comprising separate nucleic acid sequences can be readily linked post-synthetically by methods and reagents known in the art and such linked constructs are within the scope of the invention. Alternately, the first region and second region of the multifunctional siNA can comprise a single nucleic acid sequence having some degree of self complementarity, such as in a hairpin or stem-loop structure. Non-limiting examples of such double stranded and hairpin multifunctional short interfering nucleic acids are illustrated in FIGS. 16 and 17 respectively. These multifunctional short interfering nucleic acids (multifunctional siNAs) can optionally include certain overlapping nucleotide sequence where such overlapping nucleotide sequence is present in between the first region and the second region of the multifunctional siNA (see for example FIGS. 18 and 19).

In one embodiment, the invention features a multifunctional short interfering nucleic acid (multifunctional siNA) molecule, wherein each strand of the multifunctional siNA independently comprises a first region of nucleic acid sequence that is complementary to a distinct target nucleic acid sequence and the second region of nucleotide sequence that is not complementary to the target sequence. The target nucleic acid sequence of each strand is in the same target nucleic acid molecule or different target nucleic acid molecules.

In another embodiment, the multifunctional siNA comprises two strands, where: (a) the first strand comprises a region having sequence complementarity to a target nucleic acid sequence (complementary region 1) and a region having no sequence complementarity to the target nucleotide sequence (non-complementary region 1); (b) the second strand of the multifunction siNA comprises a region having sequence complementarity to a target nucleic acid sequence that is distinct from the target nucleotide sequence complementary to the first strand nucleotide sequence (complementary region 2), and a region having no sequence complementarity to the target nucleotide sequence of complementary region 2 (non-complementary region 2); (c) the complementary region 1 of the first strand comprises a nucleotide sequence that is complementary to a nucleotide sequence in the non-complementary region 2 of the second strand and the complementary region 2 of the second strand comprises a nucleotide sequence that is complementary to a nucleotide sequence in the non-complementary region 1 of the first strand. The target nucleic acid sequence of complementary region 1 and complementary region 2 is in the same target nucleic acid molecule or different target nucleic acid molecules.

In another embodiment, the multifunctional siNA comprises two strands, where: (a) the first strand comprises a region having sequence complementarity to a target nucleic acid sequence derived from a gene (e.g., HCV or host gene) (complementary region 1) and a region having no sequence complementarity to the target nucleotide sequence of complementary region 1 (non-complementary region 1); (b) the second strand of the multifunction siNA comprises a region having sequence complementarity to a target nucleic acid sequence derived from a gene that is distinct from the gene of complementary region 1 (complementary region 2), and a region having no sequence complementarity to the target nucleotide sequence of complementary region 2 (non-complementary region 2); (c) the complementary region 1 of the first strand comprises a nucleotide sequence that is complementary to a nucleotide sequence in the non-complementary region 2 of the second strand and the complementary region 2 of the second strand comprises a nucleotide sequence that is complementary to a nucleotide sequence in the non-complementary region 1 of the first strand.

In another embodiment, the multifunctional siNA comprises two strands, where: (a) the first strand comprises a region having sequence complementarity to a target nucleic acid sequence derived from a gene (e.g., HCV or host gene)

(complementary region 1) and a region having no sequence complementarity to the target nucleotide sequence of complementary region 1 (non-complementary region 1); (b) the second strand of the multifunction siNA comprises a region having sequence complementarity to a target nucleic acid sequence distinct from the target nucleic acid sequence of complementary region 1 (complementary region 2), provided, however, that the target nucleic acid sequence for complementary region 1 and target nucleic acid sequence for complementary region 2 are both derived from the same gene, and a region having no sequence complementarity to the target nucleotide sequence of complementary region 2 (non-complementary region 2); (c) the complementary region 1 of the first strand comprises a nucleotide sequence that is complementary to a nucleotide sequence in the non-complementary region 2 of the second strand and the complementary region 2 of the second strand comprises a nucleotide sequence that is complementary to nucleotide sequence in the non-complementary region 1 of the first strand.

In one embodiment, the invention features a multifunctional short interfering nucleic acid (multifunctional siNA) molecule, wherein the multifunctional siNA comprises two complementary nucleic acid sequences in which the first sequence comprises a first region having nucleotide sequence complementary to nucleotide sequence within a target nucleic acid molecule, and in which the second sequence comprises a first region having nucleotide sequence complementary to a distinct nucleotide sequence within the same target nucleic acid molecule. Preferably, the first region of the first sequence is also complementary to the nucleotide sequence of the second region of the second sequence, and where the first region of the second sequence is complementary to the nucleotide sequence of the second region of the first sequence.

In one embodiment, the invention features a multifunctional short interfering nucleic acid (multifunctional siNA) molecule, wherein the multifunctional siNA comprises two complementary nucleic acid sequences in which the first sequence comprises a first region having a nucleotide sequence complementary to a nucleotide sequence within a first target nucleic acid molecule, and in which the second sequence comprises a first region having a nucleotide sequence complementary to a distinct nucleotide sequence within a second target nucleic acid molecule. Preferably, the first region of the first sequence is also complementary to the nucleotide sequence of the second region of the second sequence, and where the first region of the second sequence is complementary to the nucleotide sequence of the second region of the first sequence.

In one embodiment, the invention features a multifunctional siNA molecule comprising a first region and a second region, where the first region comprises a nucleic acid sequence having about 18 to about 28 nucleotides complementary to a nucleic acid sequence within a first target nucleic acid molecule, and the second region comprises nucleotide sequence having about 18 to about 28 nucleotides complementary to a distinct nucleic acid sequence within a second target nucleic acid molecule.

In one embodiment, the invention features a multifunctional siNA molecule comprising a first region and a second region, where the first region comprises nucleic acid sequence having about 18 to about 28 nucleotides complementary to a nucleic acid sequence within a target nucleic acid molecule, and the second region comprises nucleotide sequence having about 18 to about 28 nucleotides complementary to a distinct nucleic acid sequence within the same target nucleic acid molecule.

In one embodiment, the invention features a double stranded multifunctional short interfering nucleic acid (multifunctional siNA) molecule, wherein one strand of the multifunctional siNA comprises a first region having nucleotide sequence complementary to a first target nucleic acid sequence, and the second strand comprises a first region having a nucleotide sequence complementary to a second target nucleic acid sequence. The first and second target nucleic acid sequences can be present in separate target nucleic acid molecules or can be different regions within the same target nucleic acid molecule. As such, multifunctional siNA molecules of the invention can be used to target the expression of different genes, splice variants of the same gene, both mutant and conserved regions of one or more gene transcripts, or both coding and non-coding sequences of the same or differing genes or gene transcripts.

In one embodiment, a target nucleic acid molecule of the invention encodes a single protein. In another embodiment, a target nucleic acid molecule encodes more than one protein (e.g., 1, 2, 3, 4, 5 or more proteins). As such, a multifunctional siNA construct of the invention can be used to down regulate or inhibit the expression of several proteins. For example, a multifunctional siNA molecule comprising a region in one strand having nucleotide sequence complementarity to a first target nucleic acid sequence derived from a viral genome (e.g., HCV) and the second strand comprising a region with nucleotide sequence complementarity to a second target nucleic acid sequence present in target nucleic acid molecules derived from genes encoding two proteins (e.g., two differing host proteins involved in the HCV life-cycle) can be used to down regulate, inhibit, or shut down a particular biologic pathway by targeting, for example, a viral RNA (e.g., HCV RNA) and one or more host RNAs that are involved in viral infection or the viral life-cycle (e.g., La antigen or interferon regulatory factors).

In one embodiment the invention takes advantage of conserved nucleotide sequences present in different isoforms of cytokines or ligands and receptors for the cytokines or ligands. By designing multifunctional siNAs in a manner where one strand includes a sequence that is complementary to a target nucleic acid sequence conserved among various isoforms of a cytokine and the other strand includes sequence that is complementary to a target nucleic acid sequence conserved among the receptors for the cytokine, it is possible to selectively and effectively modulate or inhibit a biological pathway or multiple genes in a biological pathway using a single multifunctional siNA.

In one embodiment, a multifunctional short interfering nucleic acid (multifunctional siNA) of the invention comprises a first region and a second region, wherein the first region comprises nucleotide sequence complementary to a first target RNA of a first target and the second region comprises nucleotide sequence complementary to a second target RNA of a second target. In one embodiment, the first and second regions can comprise nucleotide sequence complementary to shared or conserved RNA sequences of differing target sites within the same target sequence or shared amongst different target sequences.

In another non-limiting example, a multifunctional siNA molecule comprising a region in one strand having a nucleotide sequence complementarity to a first target nucleic acid sequence derived from a target nucleic acid molecule encoding a virus or a viral protein (e.g., HIV) and the second strand comprising a region having a nucleotide sequence complementarity to a second target nucleic acid sequence present in target nucleic acid molecule encoding a cellular protein (e.g., a receptor for the virus, such as CCR5 receptor for HIV) can be used to down regulate, inhibit, or shut down the viral replication and infection by targeting the virus and cellular proteins necessary for viral infection or replication.

In another nonlimiting example, a multifunctional siNA molecule comprising a region in one strand having a nucleotide sequence complementarity to a first target nucleic acid sequence (e.g., conserved sequence) present in a target nucleic acid molecule such as a viral genome (e.g., HCV RNA) and the second strand comprising a region having a nucleotide sequence complementarity to a second target nucleic acid sequence (e.g., conserved sequence) present in target nucleic acid molecule derived from a gene encoding a viral protein (e.g., HCV proteins) to down regulate, inhibit, or shut down the viral replication and infection by targeting the viral genome and viral encoded proteins necessary for viral infection or replication.

In one embodiment the invention takes advantage of conserved nucleotide sequences present in different strains, isotypes or forms of a virus and genes encoded by these different strains, isotypes and forms of the virus (e.g., HCV). By designing multifunctional siNAs in a manner where one strand includes a sequence that is complementary to target nucleic acid sequence conserved among various strains, isotypes or forms of a virus and the other strand includes sequence that is complementary to target nucleic acid sequence conserved in a protein encoded by the virus, it is possible to selectively and effectively inhibit viral replication or infection using a single multifunctional siNA.

In one embodiment, a multifunctional short interfering nucleic acid (multifunctional siNA) of the invention comprises a first region and a second region, wherein the first region comprises nucleotide sequence complementary to a HCV viral RNA of a first viral strain and the second region comprises nucleotide sequence complementary to a HCV viral RNA of a second viral strain. In one embodiment, the first and second regions can comprise nucleotide sequence complementary to shared or conserved RNA sequences of differing viral strains or classes or viral strains.

In one embodiment, a multifunctional short interfering nucleic acid (multifunctional siNA) of the invention comprises a region in each strand, wherein the region in one strand comprises a nucleotide sequence complementary to a HCV viral RNA encoding one or more HCV viruses (e.g., one or more strains of HCV) and the region in the second strand comprises nucleotide sequence complementary to a viral RNA encoding one or more interferon agonist proteins. In one embodiment, the first region can comprise a nucleotide sequence complementary to shared or conserved RNA sequences of differing HCV viral strains or classes of HCV viral strains. Non-limiting example of interferon agonist proteins include any protein that is capable of inhibition or suppressing RNA silencing (e.g., RNA binding proteins such as E3L or NS1 or equivalents thereof, see for example Li et al., 2004, *PNAS*, 101, 1350-1355).

In one embodiment, a multifunctional short interfering nucleic acid (multifunctional siNA) of the invention comprises a first region and a second region, wherein the first region comprises nucleotide sequence complementary to a HCV viral RNA and the second region comprises nucleotide sequence complementary to a cellular RNA that is involved in HCV viral infection and/or replication. Non-limiting examples of cellular RNAs involved in viral infection and/or replication include cellular receptors, cell surface molecules, cellular enzymes, cellular transcription factors, and/or cytokines, second messengers, and cellular accessory molecules including, but not limited to, La antigen, FAS, interferon agonsit proteins (e.g., E3L or NS1 or equivalents thereof, see for example Li et al., 2004, *PNAS*, 101, 1350-1355), interferon regulatory factors (IRFs); cellular PKR protein kinase (PKR); human eukaryotic initiation factors 2B (eIF2B gamma and/or eIF2gamma); human DEAD Box protein (DDX3); and cellular proteins that bind to the poly(U) tract of the HCV 3'-UTR, such as polypyrimidine tract-binding protein.

In one embodiment, a double stranded multifunctional siNA molecule of the invention comprises a structure having Formula MF-I:

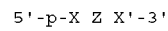

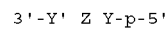

wherein each 5'-p-XZX'-3' and 5'-p-YZY'-3' are independently an oligonucleotide of length of about 20 nucleotides to about 300 nucleotides, preferably of about 20 to about 200 nucleotides, about 20 to about 100 nucleotides, about 20 to about 40 nucleotides, about 20 to about 40 nucleotides, about 24 to about 38 nucleotides, or about 26 to about 38 nucleotides; XZ comprises a nucleic acid sequence that is complementary to a first target nucleic acid sequence; YZ is an oligonucleotide comprising nucleic acid sequence that is complementary to a second target nucleic acid sequence; Z comprises nucleotide sequence of length about 1 to about 24 nucleotides (e.g., about 1, 2, 3, 4, 5, 6, 7, 8, 9, 10, 11, 12, 13, 14, 15, 16, 17, 18, 19, 20, 21, 22, 23, or 24 nucleotides) that is self complementary; X comprises nucleotide sequence of length about 1 to about 100 nucleotides, preferably about 1 to about 21 nucleotides (e.g., about 1, 2, 3, 4, 5, 6, 7, 8, 9, 10, 11, 12, 13, 14, 15, 16, 17, 18, 19, 20, or 21 nucleotides) that is complementary to nucleotide sequence present in region Y'; Y comprises nucleotide sequence of length about 1 to about 100 nucleotides, preferably about 1 to about 21 nucleotides (e.g., about 1, 2, 3, 4, 5, 6, 7, 8, 9, 10, 11, 12, 13, 14, 15, 16, 17, 18, 19, 20 or 21 nucleotides) that is complementary to nucleotide sequence present in region X'; each p comprises a terminal phosphate group that is independently present or absent; each XZ and YZ is independently of length sufficient to stably interact (i.e., base pair) with the first and second target nucleic acid sequence, respectively, or a portion thereof. For example, each sequence X and Y can independently comprise sequence from about 12 to about 21 or more nucleotides in length (e.g., about 12, 13, 14, 15, 16, 17, 18, 19, 20, 21, or more) that is complementary to a target nucleotide sequence in different target nucleic acid molecules, such as target RNAs or a portion thereof. In another non-limiting example, the length of the nucleotide sequence of X and Z together that is complementary to the first target nucleic acid sequence or a portion thereof is from about 12 to about 21 or more nucleotides (e.g., about 12, 13, 14, 15, 16, 17, 18, 19, 20, 21, or more). In another non-limiting example, the length of the nucleotide sequence of Y and Z together, that is complementary to the second target nucleic acid sequence or a portion thereof is from about 12 to about 21 or more nucleotides (e.g., about 12, 13, 14, 15, 16, 17, 18, 19, 20, 21, or more). In one embodiment, the first target nucleic acid sequence and the second target nucleic acid sequence are present in the same target nucleic acid molecule (e.g., HCV RNA or host RNA). In another embodiment, the first target nucleic acid sequence and the second target nucleic acid sequence are present in different target nucleic acid molecules (e.g., HCV RNA and host RNA). In one embodiment, Z comprises a palindrome or a repeat sequence. In one embodiment, the lengths of oligonucleotides X and X' are identical. In another embodiment, the lengths of oligonucleotides X and X' are not identical. In one embodiment, the lengths of oligonucleotides Y and Y' are identical. In another embodiment, the lengths of oligonucleotides Y and Y' are not identical. In one embodiment, the double stranded oligonucleotide construct of Formula I(a) includes one or more, specifically 1, 2, 3 or 4, mismatches, to the extent such mismatches do not significantly diminish the ability of the double stranded oligonucleotide to inhibit target gene expression.

In one embodiment, a multifunctional siNA molecule of the invention comprises a structure having Formula MF-II:

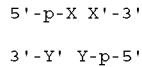

wherein each 5'-p-XX'-3' and 5'-p-YY'-3' are independently an oligonucleotide of length of about 20 nucleotides to about 300 nucleotides, preferably about 20 to about 200 nucleotides, about 20 to about 100 nucleotides, about 20 to about 40 nucleotides, about 20 to about 40 nucleotides, about 24 to about 38 nucleotides, or about 26 to about 38 nucleotides; X comprises a nucleic acid sequence that is complementary to a first target nucleic acid sequence; Y is an oligonucleotide comprising nucleic acid sequence that is complementary to a second target nucleic acid sequence; X comprises a nucleotide sequence of length about 1 to about 100 nucleotides, preferably about 1 to about 21 nucleotides (e.g., about 1, 2, 3, 4, 5, 6, 7, 8, 9, 10, 11, 12, 13, 14, 15, 16, 17, 18, 19, 20, or 21 nucleotides) that is complementary to nucleotide sequence present in region Y'; Y comprises nucleotide sequence of length about 1 to about 100 nucleotides, preferably about 1 to about 21 nucleotides (e.g., about 1, 2, 3, 4, 5, 6, 7, 8, 9, 10, 11, 12, 13, 14, 15, 16, 17, 18, 19, 20 or 21 nucleotides) that is complementary to nucleotide sequence present in region X'; each p comprises a terminal phosphate group that is independently present or absent; each X and Y independently is of length sufficient to stably interact (i.e., base pair) with the first and second target nucleic acid sequence, respectively, or a portion thereof. For example, each sequence X and Y can independently comprise sequence from about 12 to about 21 or more nucleotides in length (e.g., about 12, 13, 14, 15, 16, 17, 18, 19, 20, 21, or more) that is complementary to a target nucleotide sequence in different target nucleic acid molecules, such as target RNAs or a portion thereof. In one embodiment, the first target nucleic acid sequence and the second target nucleic acid sequence are present in the same target nucleic acid molecule (e.g., HCV RNA or host RNA). In another embodiment, the first target nucleic acid sequence and the second HCV target nucleic acid sequence are present in different target nucleic acid molecules (e.g., HCV RNA and host RNA). In one embodiment, Z comprises a palindrome or a repeat sequence. In one embodiment, the lengths of oligonucleotides X and X' are identical. In another embodiment, the lengths of oligonucleotides X and X' are not identical. In one embodiment, the lengths of oligonucleotides Y and Y' are identical. In another embodiment, the lengths of oligonucleotides Y and Y' are not identical. In one embodiment, the double stranded oligonucleotide construct of Formula I(a) includes one or more, specifically 1, 2, 3 or 4, mismatches, to the extent such mismatches do not significantly diminish the ability of the double stranded oligonucleotide to inhibit target gene expression.

In one embodiment, a multifunctional siNA molecule of the invention comprises a structure having Formula MF-III:

wherein each X, X', Y, and Y' is independently an oligonucleotide of length of about 15 nucleotides to about 50 nucleotides, preferably about 18 to about 40 nucleotides, or about 19 to about 23 nucleotides; X comprises nucleotide sequence that is complementary to nucleotide sequence present in region Y'; X' comprises nucleotide sequence that is complementary to nucleotide sequence present in region Y; each X and X' is In one embodiment independently of length sufficient to stably interact (i.e., base pair) with a first and a second target nucleic acid sequence, respectively, or a portion thereof; W represents a nucleotide or non-nucleotide linker that connects sequences Y' and Y; and the multifunctional siNA directs cleavage of the first and second target sequence via RNA interference. nt, the first target nucleic acid sequence and the second target nucleic acid sequence are present in the same target nucleic acid molecule (e.g., HCV RNA or host RNA). In another embodiment, the first target nucleic acid sequence and the second target nucleic acid sequence are present in different target nucleic acid molecules (e.g., HCV RNA and host RNA). In one embodiment, region W connects the 3'-end of sequence Y' with the 3'-end of sequence Y. In one embodiment, region W connects the 3'-end of sequence Y' with the 5'-end of sequence Y. In one embodiment, region W connects the 5'-end of sequence Y' with the 5'-end of sequence Y. In one embodiment, region W connects the 5'-end of sequence Y' with the 3'-end of sequence Y. In one embodiment, a terminal phosphate group is present at the 5'-end of sequence X. In one embodiment, a terminal phosphate group is present at the 5'-end of sequence X'. In one embodiment, a terminal phosphate group is present at the 5'-end of sequence Y. In one embodiment, a terminal phosphate group is present at the 5'-end of sequence Y'. In one embodiment, W connects sequences Y and Y' via a biodegradable linker. In one embodiment, W further comprises a conjugate, label, aptamer, ligand, lipid, or polymer.

In one embodiment, a multifunctional siNA molecule of the invention comprises a structure having Formula MF-IV:

wherein each X, X', Y, and Y' is independently an oligonucleotide of length of about 15 nucleotides to about 50 nucleotides, preferably about 18 to about 40 nucleotides, or about 19 to about 23 nucleotides; X comprises nucleotide sequence that is complementary to nucleotide sequence present in region Y'; X' comprises nucleotide sequence that is complementary to nucleotide sequence present in region Y; each Y and Y' is independently of length sufficient to stably interact (i.e., base pair) with a first and a second target nucleic acid sequence, respectively, or a portion thereof; W represents a nucleotide or non-nucleotide linker that connects sequences Y' and Y; and the multifunctional siNA directs cleavage of the first and second target sequence via RNA interference. In one embodiment, the first target nucleic acid sequence and the second target nucleic acid sequence are present in the same target nucleic acid molecule (e.g., HCV RNA or host RNA). In another embodiment, the first target nucleic acid sequence and the second target nucleic acid sequence are present in different target nucleic acid molecules (e.g., HCV RNA and host RNA). In one embodiment, region W connects the 3'-end of sequence Y' with the 3'-end of sequence Y. In one embodiment, region W connects the 3'-end of sequence Y' with the 5'-end of sequence Y. In one embodiment, region W connects the 5'-end of sequence Y' with the 5'-end of sequence Y. In one embodiment, region W connects the 5'-end of sequence Y' with the 3'-end of sequence Y. In one embodiment, a terminal phosphate group is present at the 5'-end of sequence X. In one embodiment, a terminal phosphate group is present at the 5'-end of sequence X'. In one embodiment, a terminal phosphate group is present at the 5'-end of sequence Y. In one embodiment, a terminal phosphate group is present at the 5'-end of sequence Y'. In one embodiment, W connects sequences Y and Y' via a biodegradable linker. In one embodiment, W further comprises a conjugate, lable, aptamer, ligand, lipid, or polymer.

In one embodiment, a multifunctional siNA molecule of the invention comprises a structure having Formula MF-V:

wherein each X, X', Y, and Y' is independently an oligonucleotide of length of about 15 nucleotides to about 50 nucleotides, preferably about 18 to about 40 nucleotides, or about 19 to about 23 nucleotides; X comprises nucleotide sequence that is complementary to nucleotide sequence present in region Y'; X' comprises nucleotide sequence that is complementary to nucleotide sequence present in region Y; each X, X', Y, or Y' is independently of length sufficient to stably interact (i.e., base pair) with a first, second, third, or fourth target nucleic acid sequence, respectively, or a portion thereof; W represents a nucleotide or non-nucleotide linker that connects sequences Y' and Y; and the multifunctional siNA directs cleavage of the first, second, third, and/or fourth target sequence via RNA interference. In one embodiment, the first, second, third and fourth target nucleic acid sequence are all present in the same target nucleic acid molecule (e.g., HCV RNA or host RNA). In another embodiment, the first, second, third and fourth target nucleic acid sequence are independently present in different target nucleic acid molecules (e.g., HCV RNA and host RNA). In one embodiment, region W connects the 3'-end of sequence Y' with the 3'-end of sequence Y. In one embodiment, region W connects the 3'-end of sequence Y' with the 5'-end of sequence Y. In one embodiment, region W connects the 5'-end of sequence Y' with the 5'-end of sequence Y. In one embodiment, region W connects the 5'-end of sequence Y' with the 3'-end of sequence Y. In one embodiment, a terminal phosphate group is present at the 5'-end of sequence X. In one embodiment, a terminal phosphate group is present at the 5'-end of sequence X'. In one embodiment, a terminal phosphate group is present at the 5'-end of sequence Y. In one embodiment, a terminal phosphate group is present at the 5'-end of sequence Y'. In one embodiment, W connects sequences Y and Y' via a biodegradable linker. In one embodiment, W further comprises a conjugate, lable, aptamer, ligand, lipid, or polymer.

In one embodiment, regions X and Y of multifunctional siNA molecule of the invention (e.g., having any of Formula MF-I-MF-V), are complementary to different target nucleic acid sequences that are portions of the same target nucleic acid molecule. In one embodiment, such target nucleic acid sequences are at different locations within the coding region of a RNA transcript. In one embodiment, such target nucleic acid sequences comprise coding and non-coding regions of the same RNA transcript. In one embodiment, such target nucleic acid sequences comprise regions of alternately spliced transcripts or precursors of such alternately spliced transcripts.

In one embodiment, a multifunctional siNA molecule having any of Formula MF-I-MF-V can comprise chemical modifications as described herein without limitation, such as, for example, nucleotides having any of Formulae I-VII described herein, stabilization chemistries as described in Table IV, or any other combination of modified nucleotides and non-nucleotides as described in the various embodiments herein.

In one embodiment, the palidrome or repeat sequence or modified nucleotide (e.g., nucleotide with a modified base, such as 2-amino purine or a universal base) in Z of multifunctional siNA constructs having Formula MF-I or MF-II comprises chemically modified nucleotides that are able to interact with a portion of the target nucleic acid sequence (e.g., modified base analogs that can form Watson Crick base pairs or non-Watson Crick base pairs).

In one embodiment, a multifunctional siNA molecule of the invention, for example each strand of a multifunctional siNA having MF-I-MF-V, independently comprises about 15 to about 40 nucleotides (e.g., about 15, 16, 17, 18, 19, 20, 21, 22, 23, 24, 25, 26, 27, 28, 29, 30, 31, 32, 33, 34, 35, 36, 37, 38, 39, or 40 nucleotides). In one embodiment, a multifunctional siNA molecule of the invention comprises one or more chemical modifications. In a non-limiting example, the introduction of chemically modified nucleotides and/or non-nucleotides into nucleic acid molecules of the invention provides a powerful tool in overcoming potential limitations of in vivo stability and bioavailability inherent to unmodified RNA molecules that are delivered exogenously. For example, the use of chemically modified nucleic acid molecules can enable a lower dose of a particular nucleic acid molecule for a given therapeutic effect since chemically modified nucleic acid molecules tend to have a longer half-life in serum or in cells or tissues. Furthermore, certain chemical modifications can improve the bioavailability and/or potency of nucleic acid molecules by not only enhancing half-life but also facilitating the targeting of nucleic acid molecules to particular organs, cells or tissues and/or improving cellular uptake of the nucleic acid molecules. Therefore, even if the activity of a chemically modified nucleic acid molecule is reduced in vitro as compared to a native/unmodified nucleic acid molecule, for example when compared to an unmodified RNA molecule, the overall activity of the modified nucleic acid molecule can be greater than the native or unmodified nucleic acid molecule due to improved stability, potency, duration of effect, bioavailability and/or delivery of the molecule.

In another embodiment, the invention features multifunctional siNAs, wherein the multifunctional siNAs are assembled from two separate double-stranded siNAs, with one of the ends of each sense strand is tethered to the end of the sense strand of the other siNA molecule, such that the two antisense siNA strands are annealed to their corresponding sense strand that are tethered to each other at one end (see FIG. 22). The tethers or linkers can be nucleotide-based linkers or non-nucleotide based linkers as generally known in the art and as described herein.

In one embodiment, the invention features a multifunctional siNA, wherein the multifunctional siNA is assembled from two separate double-stranded siNAs, with the 5'-end of one sense strand of the siNA is tethered to the 5'-end of the sense strand of the other siNA molecule, such that the 5'-ends of the two antisense siNA strands, annealed to their corresponding sense strand that are tethered to each other at one end, point away (in the opposite direction) from each other (see FIG. 22 (A)). The tethers or linkers can be nucleotide-based linkers or non-nucleotide based linkers as generally known in the art and as described herein.

In one embodiment, the invention features a multifunctional siNA, wherein the multifunctional siNA is assembled from two separate double-stranded siNAs, with the 3'-end of one sense strand of the siNA is tethered to the 3'-end of the sense strand of the other siNA molecule, such that the 5'-ends of the two antisense siNA strands, annealed to their corresponding sense strand that are tethered to each other at one end, face each other (see FIG. 22 (B)). The tethers or linkers can be nucleotide-based linkers or non-nucleotide based linkers as generally known in the art and as described herein.

In one embodiment, the invention features a multifunctional siNA, wherein the multifunctional siNA is assembled from two separate double-stranded siNAs, with the 5'-end of one sense strand of the siNA is tethered to the 3'-end of the sense strand of the other siNA molecule, such that the 5'-end of the one of the antisense siNA strands annealed to their corresponding sense strand that are tethered to each other at one end, faces the 3'-end of the other antisense strand (see FIG. 22 (C-D)). The tethers or linkers can be nucleotide-based linkers or non-nucleotide based linkers as generally known in the art and as described herein.

In one embodiment, the invention features a multifunctional siNA, wherein the multifunctional siNA is assembled from two separate double-stranded siNAs, with the 5'-end of one antisense strand of the siNA is tethered to the 3'-end of the antisense strand of the other siNA molecule, such that the 5'-end of the one of the sense siNA strands annealed to their corresponding antisense sense strand that are tethered to each other at one end, faces the 3'-end of the other sense strand (see FIG. 22 (G-H)). In one embodiment, the linkage between the 5'-end of the first antisense strand and the 3'-end of the second antisense strand is designed in such a way as to be readily cleavable (e.g., biodegradable linker) such that the 5' end of each antisense strand of the multifunctional siNA has a free 5'-end suitable to mediate RNA interference-based cleavage of the target RNA. The tethers or linkers can be nucleotide-based linkers or non-nucleotide based linkers as generally known in the art and as described herein.

In one embodiment, the invention features a multifunctional siNA, wherein the multifunctional siNA is assembled from two separate double-stranded siNAs, with the 5'-end of one antisense strand of the siNA is tethered to the 5'-end of the antisense strand of the other siNA molecule, such that the 3'-end of the one of the sense siNA strands annealed to their corresponding antisense sense strand that are tethered to each other at one end, faces the 3'-end of the other sense strand (see FIG. 22 (E)). In one embodiment, the linkage between the 5'-end of the first antisense strand and the 5'-end of the second antisense strand is designed in such a way as to be readily cleavable (e.g., biodegradable linker) such that the 5' end of each antisense strand of the multifunctional siNA has a free 5'-end suitable to mediate RNA interference-based cleavage of the target RNA. The tethers or linkers can be nucleotide-based linkers or non-nucleotide based linkers as generally known in the art and as described herein.

In one embodiment, the invention features a multifunctional siNA, wherein the multifunctional siNA is assembled from two separate double-stranded siNAs, with the 3'-end of one antisense strand of the siNA is tethered to the 3'-end of the antisense strand of the other siNA molecule, such that the 5'-end of the one of the sense siNA strands annealed to their corresponding antisense sense strand that are tethered to each other at one end, faces the 3'-end of the other sense strand (see FIG. 22 (F)). In one embodiment, the linkage between the 5'-end of the first antisense strand and the 5'-end of the second antisense strand is designed in such a way as to be readily cleavable (e.g., biodegradable linker) such that the 5' end of each antisense strand of the multifunctional siNA has a free 5'-end suitable to mediate RNA interference-based cleavage of the target RNA. The tethers or linkers can be nucleotide-based linkers or non-nucleotide based linkers as generally known in the art and as described herein.

In any of the above embodiments, a first target nucleic acid sequence or second target nucleic acid sequence can independently comprise HCV RNA or a portion thereof or a polynucleotide coding or non-coding sequence of cellular or host target that is involved in HCV infection or replication, or disease processes associated with HCV infection such as such as cellular receptors, cell surface molecules, cellular enzymes, cellular transcription factors, and/or cytokines, second messengers, and cellular accessory molecules including, but not limited to, La antigen (see for example Costa-Mattioli et al., 2004, *Mol Cell Biol.*, 24, 6861-70, e.g., Genbank Accession No. NM_003142); FAS (e.g., Genbank Accession No. NM_000043) or FAS ligand (e.g., Genbank Accession No. NM_000639); interferon regulatory factors (IRFs; e.g., Genbank Accession No. AF082503.1); cellular PKR protein kinase (e.g., Genbank Accession No. XM_002661.7); human eukaryotic initiation factors 2B (elF2Bgamma; e.g., Genbank Accession No. AF256223, and/or elF2gamma; e.g., Genbank Accession No. NM_006874.1); human DEAD Box protein (DDX3; e.g., Genbank Accession No. XM_018021.2); and cellular proteins that bind to the poly (U) tract of the HCV 3'-UTR, such as polypyrimidine tract-binding protein (e.g., Genbank Accession Nos. NM_031991.1 and XM_042972.3). In one embodiment, the first HCV target nucleic acid sequence is a HCV RNA or a portion thereof and the second HCV target nucleic acid sequence is a HCV RNA of a portion thereof. In one embodiment, the first HCV target nucleic acid sequence is a HCV RNA or a portion thereof and the second HCV target nucleic acid sequence is a host RNA or a portion thereof. In one embodiment, the first HCV target nucleic acid sequence is a host RNA or a portion thereof and the second HCV target nucleic acid sequence is a host RNA or a portion thereof. In one embodiment, the first HCV target nucleic acid sequence is a host RNA or a portion thereof and the second HCV target nucleic acid sequence is a HCV RNA or a portion thereof.

Synthesis of Nucleic Acid Molecules

Synthesis of nucleic acids greater than 100 nucleotides in length is difficult using automated methods, and the therapeutic cost of such molecules is prohibitive. In this invention, small nucleic acid motifs ("small" refers to nucleic acid motifs no more than 100 nucleotides in length, preferably no more than 80 nucleotides in length, and most preferably no more than 50 nucleotides in length; e.g., individual siNA oligonucleotide sequences or siNA sequences synthesized in tandem) are preferably used for exogenous delivery. The simple structure of these molecules increases the ability of the nucleic acid to invade targeted regions of protein and/or RNA structure. Exemplary molecules of the instant invention are chemically synthesized, and others can similarly be synthesized.

Oligonucleotides (e.g., certain modified oligonucleotides or portions of oligonucleotides lacking ribonucleotides) are synthesized using protocols known in the art, for example as described in Caruthers et al., 1992, *Methods in Enzymology* 211, 3-19, Thompson et al., International PCT Publication No. WO 99/54459, Wincott et al., 1995, *Nucleic Acids Res.* 23, 2677-2684, Wincott et al., 1997, *Methods Mol. Bio.*, 74, 59, Brennan et al., 1998, *Biotechnol Bioeng.*, 61, 33-45, and Brennan, U.S. Pat. No. 6,001,311. All of these references are incorporated herein by reference. The synthesis of oligonucleotides makes use of common nucleic acid protecting and coupling groups, such as dimethoxytrityl at the 5'-end, and phosphoramidites at the 3'-end. In a non-limiting example, small scale syntheses are conducted on a 394 Applied Biosystems, Inc. synthesizer using a 0.2 µmol scale protocol with a 2.5 min coupling step for 2'-O-methylated nucleotides and a 45 second coupling step for 2'-deoxy nucleotides or 2'-deoxy-2'-fluoro nucleotides. Table V outlines the amounts and the contact times of the reagents used in the synthesis cycle. Alternatively, syntheses at the 0.2 µmol scale can be performed on a 96-well plate synthesizer, such as the instrument produced by Protogene (Palo Alto, Calif.) with minimal modification to the cycle. A 33-fold excess (60 µL of 0.11 M=6.6 µmol) of 2'-O-methyl phosphoramidite and a 105-fold excess of S-ethyl tetrazole (60 µL of 0.25 M=15 µmol) can be used in each coupling cycle of 2'-O-methyl residues relative to polymer-bound 5'-hydroxyl. A 22-fold excess (40 µL of 0.11 M=4.4 µmol) of deoxy phosphoramidite and a 70-fold excess of S-ethyl tetrazole (40 µL of 0.25 M=10 µmol) can be used in each coupling cycle of deoxy residues relative to polymer-bound 5'-hydroxyl. Average coupling yields on the 394 Applied Biosystems, Inc. synthesizer, determined by colorimetric quantitation of the trityl fractions, are typically 97.5-99%. Other oligonucleotide synthesis reagents for the 394 Applied Biosystems, Inc. synthesizer include the following: detritylation solution is 3% TCA in methylene chloride (ABI); capping is performed with 16% N-methyl imidazole in THF (ABI) and 10% acetic anhydride/10% 2,6-lutidine in THF (ABI); and oxidation solution is 16.9 mM 12, 49 mM pyridine, 9% water in THF (PerSeptive Biosystems, Inc.). Burdick & Jackson Synthesis Grade acetonitrile is used directly from the reagent bottle. S-Ethyltetrazole solution (0.25 M in acetonitrile) is made up from the solid obtained from American International Chemical, Inc. Alternately, for the introduction of phosphorothioate linkages, Beaucage reagent (3H-1,2-Benzodithiol-3-one 1,1-dioxide, 0.05 M in acetonitrile) is used.

Deprotection of the DNA-based oligonucleotides is performed as follows: the polymer-bound trityl-on oligoribonucleotide is transferred to a 4 mL glass screw top vial and suspended in a solution of 40% aqueous methylamine (1 mL) at 65° C. for 10 minutes. After cooling to −20° C., the supernatant is removed from the polymer support. The support is washed three times with 1.0 mL of EtOH:MeCN:H2O/3:1:1, vortexed and the supernatant is then added to the first supernatant. The combined supernatants, containing the oligoribonucleotide, are dried to a white powder. In one embodiment, the nucleic acid molecules of the invention are synthesized, deprotected, and analyzed according to methods described in U.S. Pat. Nos. 6,995,259, 6,686,463, 6,673,918, 6,649,751, 6,989,442, and U.S. Ser. No. 10/190,359, all incorporated by reference herein in their entirety.

The method of synthesis used for RNA including certain siNA molecules of the invention follows the procedure as described in Usman et al., 1987, *J. Am. Chem. Soc.*, 109, 7845; Scaringe et al., 1990, *Nucleic Acids Res.*, 18, 5433; and Wincott et al., 1995, *Nucleic Acids Res.* 23, 2677-2684 Wincott et al., 1997, *Methods Mol. Bio.*, 74, 59, and makes use of common nucleic acid protecting and coupling groups, such as dimethoxytrityl at the 5'-end, and phosphoramidites at the 3'-end. In a non-limiting example, small scale syntheses are conducted on a 394 Applied Biosystems, Inc. synthesizer using a 0.2 µmol scale protocol with a 7.5 min coupling step for alkylsilyl protected nucleotides and a 2.5 min coupling step for 2'-O-methylated nucleotides. Table V outlines the amounts and the contact times of the reagents used in the synthesis cycle. Alternatively, syntheses at the 0.2 µmol scale can be done on a 96-well plate synthesizer, such as the instrument produced by Protogene (Palo Alto, Calif.) with minimal modification to the cycle. A 33-fold excess (60 µL of 0.11 M=6.6 µmol) of 2'-O-methyl phosphoramidite and a 75-fold excess of S-ethyl tetrazole (60 µL of 0.25 M=15 µmol) can be used in each coupling cycle of 2'-O-methyl residues relative to polymer-bound 5'-hydroxyl. A 66-fold excess (120 µL of 0.11 M=13.2 µmol) of alkylsilyl (ribo) protected phosphoramidite and a 150-fold excess of S-ethyl tetrazole (120 µL of 0.25 M=30 µmol) can be used in each coupling cycle of ribo residues relative to polymer-bound 5'-hydroxyl. Average coupling yields on the 394 Applied Biosystems, Inc. synthesizer, determined by colorimetric quantitation of the trityl fractions, are typically 97.5-99%. Other oligonucleotide synthesis reagents for the 394 Applied Biosystems, Inc. synthesizer include the following: detritylation solution is 3% TCA in methylene chloride (ABI); capping is performed with 16% N-methyl imidazole in THF (ABI) and 10% acetic anhydride/10% 2,6-lutidine in THF (ABI); oxidation solution is 16.9 mM 12, 49 mM pyridine, 9% water in THF (PerSeptive Biosystems, Inc.). Burdick & Jackson Synthesis Grade acetonitrile is used directly from the reagent bottle. S-Ethyltetrazole solution (0.25 M in acetonitrile) is made up from the solid obtained from American International Chemical, Inc. Alternately, for the introduction of phosphorothioate linkages, Beaucage reagent (3H-1,2-Benzodithiol-3-one 1,1-dioxide 0.05 M in acetonitrile) is used.

Deprotection of the RNA is performed using either a two-pot or one-pot protocol. For the two-pot protocol, the polymer-bound trityl-on oligoribonucleotide is transferred to a 4 mL glass screw top vial and suspended in a solution of 40% aq. methylamine (1 mL) at 65° C. for 10 min. After cooling to −20° C., the supernatant is removed from the polymer support. The support is washed three times with 1.0 mL of EtOH: MeCN:H2O/3:1:1, vortexed and the supernatant is then added to the first supernatant. The combined supernatants, containing the oligoribonucleotide, are dried to a white powder. The base deprotected oligoribonucleotide is resuspended in anhydrous TEA/HF/NMP solution (300 µL of a solution of 1.5 mL N-methylpyrrolidinone, 750 µL TEA and 1 mL TEA•3HF to provide a 1.4 M HF concentration) and heated to 65° C. After 1.5 h, the oligomer is quenched with 1.5 M NH4HCO3. In one embodiment, the nucleic acid molecules of the invention are synthesized, deprotected, and analyzed according to methods described in U.S. Pat. Nos. 6,995,259, 6,686,463, 6,673,918, 6,649,751, 6,989,442, and U.S. Ser. No. 10/190,359, all incorporated by reference herein in their entirety.

Alternatively, for the one-pot protocol, the polymer-bound trityl-on oligoribonucleotide is transferred to a 4 mL glass screw top vial and suspended in a solution of 33% ethanolic methylamine/DMSO: 1/1 (0.8 mL) at 65° C. for 15 minutes. The vial is brought to room temperature TEA•3HF (0.1 mL) is added and the vial is heated at 65° C. for 15 minutes. The sample is cooled at −20° C. and then quenched with 1.5 M NH4HCO3.

For purification of the trityl-on oligomers, the quenched NH4HCO3 solution is loaded onto a C-18 containing cartridge that had been prewashed with acetonitrile followed by 50 mM TEAA. After washing the loaded cartridge with water, the RNA is detritylated with 0.5% TFA for 13 minutes. The cartridge is then washed again with water, salt exchanged with 1 M NaCl and washed with water again. The oligonucleotide is then eluted with 30% acetonitrile.

The average stepwise coupling yields are typically >98% (Wincott et al., 1995 *Nucleic Acids Res.* 23, 2677-2684). Those of ordinary skill in the art will recognize that the scale of synthesis can be adapted to be larger or smaller than the example described above including but not limited to 96-well format.

Alternatively, the nucleic acid molecules of the present invention can be synthesized separately and joined together post-synthetically, for example, by ligation (Moore et al., 1992, *Science* 256, 9923; Draper et al., International PCT publication No. WO 0.93/23569; Shabarova et al., 1991, *Nucleic Acids Research* 19, 4247; Bellon et al., 1997, *Nucleosides & Nucleotides*, 16, 951; Bellon et al., 1997, *Bioconjugate Chem.* 8, 204), or by hybridization following synthesis and/or deprotection.

The siNA molecules of the invention can also be synthesized via a tandem synthesis methodology as described in Example 1 herein, wherein both siNA strands are synthesized as a single contiguous oligonucleotide fragment or strand separated by a cleavable linker which is subsequently cleaved to provide separate siNA fragments or strands that hybridize and permit purification of the siNA duplex. The linker can be a polynucleotide linker or a non-nucleotide linker. The tandem synthesis of siNA as described herein can be readily adapted to both multiwell/multiplate synthesis platforms such as 96 well or similarly larger multi-well platforms. The tandem synthesis of siNA as described herein can also be readily adapted to large scale synthesis platforms employing batch reactors, synthesis columns and the like.

A siNA molecule can also be assembled from two distinct nucleic acid strands or fragments wherein one fragment includes the sense region and the second fragment includes the antisense region of the RNA molecule.

The nucleic acid molecules of the present invention can be modified extensively to enhance stability by modification with nuclease resistant groups, for example, 2'-amino, 2'-C-allyl, 2'-fluoro, 2'-O-methyl, 2'-H (for a review see Usman and Cedergren, 1992, *TIBS* 17, 34; Usman et al., 1994, *Nucleic Acids Symp. Ser.* 31, 163). siNA constructs can be purified by gel electrophoresis using general methods or can be purified by high pressure liquid chromatography (HPLC; see Wincott et al., supra, the totality of which is hereby incorporated herein by reference) and re-suspended in water.

In another aspect of the invention, siNA molecules of the invention are expressed from transcription units inserted into DNA or RNA vectors. The recombinant vectors can be DNA plasmids or viral vectors. siNA expressing viral vectors can be constructed based on, but not limited to, adeno-associated virus, retrovirus, adenovirus, or alphavirus. The recombinant vectors capable of expressing the siNA molecules can be delivered as described herein, and persist in target cells. Alternatively, viral vectors can be used that provide for transient expression of siNA molecules.

Optimizing Activity of the Nucleic Acid Molecule of the Invention.

Chemically synthesizing nucleic acid molecules with modifications (base, sugar and/or phosphate) can prevent their degradation by serum ribonucleases, which can increase their potency (see e.g., Eckstein et al., International Publication No. WO 92/07065; Perrault et al., 1990 *Nature* 344, 565; Pieken et al., 1991, *Science* 253, 314; Usman and Cedergren, 1992, *Trends in Biochem. Sci.* 17, 334; Usman et al., International Publication No. WO 93/15187; and Rossi et al., International Publication No. WO 91/03162; Sproat, U.S. Pat. No. 5,334,711; Gold et al., U.S. Pat. No. 6,300,074; and Burgin et al., supra; all of which are incorporated by reference herein). All of the above references describe various chemical modifications that can be made to the base, phosphate and/or sugar moieties of the nucleic acid molecules described herein. Modifications that enhance their efficacy in cells, and removal of bases from nucleic acid molecules to shorten oligonucleotide synthesis times and reduce chemical requirements are desired.

There are several examples in the art describing sugar, base and phosphate modifications that can be introduced into nucleic acid molecules with significant enhancement in their nuclease stability and efficacy. For example, oligonucleotides are modified to enhance stability and/or enhance biological activity by modification with nuclease resistant groups, for example, 2'-amino, 2'-C-allyl, 2'-fluoro, 2'-O-methyl, 2'-O-allyl, 2'-H, nucleotide base modifications (for a review see Usman and Cedergren, 1992, *TIBS.* 17, 34; Usman et al., 1994, *Nucleic Acids Symp. Ser.* 31, 163; Burgin et al., 1996, *Biochemistry*, 35, 14090). Sugar modification of nucleic acid molecules have been extensively described in the art (see Eckstein et al., International Publication PCT No. WO 92/07065; Perrault et al. Nature, 1990, 344, 565-568; Pieken et al. Science, 1991, 253, 314-317; Usman and Cedergren, Trends in Biochem. Sci., 1992, 17, 334-339; Usman et al. International Publication PCT No. WO 93/15187; Sproat, U.S. Pat. No. 5,334,711 and Beigelman et al., 1995, *J. Biol. Chem.*, 270, 25702; Beigelman et al., International PCT publication No. WO 97/26270; Beigelman et al., U.S. Pat. No. 5,716,824; Usman et al., U.S. Pat. No. 5,627,053; Woolf et al., International PCT Publication No. WO 98/13526; Thompson et al., U.S. Ser. No. 60/082,404 which was filed on Apr. 20, 1998; Karpeisky et al., 1998, *Tetrahedron Lett.*, 39, 1131; Earnshaw and Gait, 1998, *Biopolymers* (Nucleic Acid Sciences), 48, 39-55; Verma and Eckstein, 1998, *Annu. Rev. Biochem.*, 67, 99-134; and Burlina et al., 1997, *Bioorg. Med. Chem.*, 5, 1999-2010; all of the references are hereby incorporated in their totality by reference herein). Such publications describe general methods and strategies to determine the location of incorporation of sugar, base and/or phosphate modifications and the like into nucleic acid molecules without modulating catalysis, and are incorporated by reference herein. In view of such teachings, similar modifications can be used as described herein to modify the siNA nucleic acid molecules of the instant invention so long as the ability of siNA to promote RNAi is cells is not significantly inhibited.

In one embodiment, a nucleic acid molecule of the invention is chemically modified as described in US 20050020521, incorporated by reference herein in its entirety.

While chemical modification of oligonucleotide internucleotide linkages with phosphorothioate, phosphorodithioate, and/or 5'-methylphosphonate linkages improves stability, excessive modifications can cause some toxicity or decreased activity. Therefore, when designing nucleic acid molecules, the amount of these internucleotide linkages should be minimized. The reduction in the concentration of these linkages should lower toxicity, resulting in increased efficacy and higher specificity of these molecules.

Short interfering nucleic acid (siNA) molecules having chemical modifications that maintain or enhance activity are provided. Such a nucleic acid is also generally more resistant to nucleases than an unmodified nucleic acid. Accordingly, the in vitro and/or in vivo activity should not be significantly lowered. In cases in which modulation is the goal, therapeutic nucleic acid molecules delivered exogenously should optimally be stable within cells until translation of the target RNA has been modulated long enough to reduce the levels of the undesirable protein. This period of time varies between hours to days depending upon the disease state. Improvements in the chemical synthesis of RNA and DNA (Wincott et al., 1995, *Nucleic Acids Res.* 23, 2677; Caruthers et al., 1992, *Methods in Enzymology* 211, 3-19 (incorporated by reference herein)) have expanded the ability to modify nucleic acid molecules by introducing nucleotide modifications to enhance their nuclease stability, as described above.

In one embodiment, nucleic acid molecules of the invention include one or more (e.g., about 1, 2, 3, 4, 5, 6, 7, 8, 9, 10, or more) G-clamp nucleotides. A G-clamp nucleotide is a modified cytosine analog wherein the modifications confer the ability to hydrogen bond both Watson-Crick and Hoogsteen faces of a complementary guanine within a duplex, see for example Lin and Matteucci, 1998, *J. Am. Chem. Soc.*, 120, 8531-8532. A single G-clamp analog substitution within an oligonucleotide can result in substantially enhanced helical thermal stability and mismatch discrimination when hybridized to complementary oligonucleotides. The inclusion of such nucleotides in nucleic acid molecules of the invention results in both enhanced affinity and specificity to nucleic acid targets, complementary sequences, or template strands. In another embodiment, nucleic acid molecules of the invention include one or more (e.g., about 1, 2, 3, 4, 5, 6, 7, 8, 9, 10, or more) LNA "locked nucleic acid" nucleotides such as a 2',4'-C methylene bicyclo nucleotide (see for example Wengel et al., International PCT Publication No. WO 00/66604 and WO 99/14226).

In another embodiment, the invention features conjugates and/or complexes of siNA molecules of the invention. Such conjugates and/or complexes can be used to facilitate delivery of siNA molecules into a biological system, such as a cell. The conjugates and complexes provided by the instant invention can impart therapeutic activity by transferring therapeutic compounds across cellular membranes, altering the pharmacokinetics, and/or modulating the localization of nucleic acid molecules of the invention. The present invention encompasses the design and synthesis of novel conjugates and complexes for the delivery of molecules, including, but not limited to, small molecules, lipids, cholesterol, phospholipids, nucleosides, nucleotides, nucleic acids, antibodies, toxins, negatively charged polymers and other polymers, for example proteins, peptides, hormones, carbohydrates, polyethylene glycols, or polyamines, across cellular membranes. In general, the transporters described are designed to be used either individually or as part of a multi-component system, with or without degradable linkers. These compounds are expected to improve delivery and/or localization of nucleic acid molecules of the invention into a number of cell types originating from different tissues, in the presence or absence of serum (see Sullenger and Cech, U.S. Pat. No. 5,854,038). Conjugates of the molecules described herein can be attached to biologically active molecules via linkers that are biodegradable, such as biodegradable nucleic acid linker molecules.

The term "biodegradable linker" as used herein, refers to a nucleic acid or non-nucleic acid linker molecule that is designed as a biodegradable linker to connect one molecule to another molecule, for example, a biologically active molecule to a siNA molecule of the invention or the sense and antisense strands of a siNA molecule of the invention. The biodegradable linker is designed such that its stability can be modulated for a particular purpose, such as delivery to a particular tissue or cell type. The stability of a nucleic acid-based biodegradable linker molecule can be modulated by using various chemistries, for example combinations of ribonucleotides, deoxyribonucleotides, and chemically-modified nucleotides, such as 2'-O-methyl, 2'-fluoro, 2'-amino, 2'-O-amino, 2'-C-allyl, 2'-O-allyl, and other 2'-modified or base modified nucleotides. The biodegradable nucleic acid linker molecule can be a dimer, trimer, tetramer or longer nucleic acid molecule, for example, an oligonucleotide of about 2, 3, 4, 5, 6, 7, 8, 9, 10, 11, 12, 13, 14, 15, 16, 17, 18, 19, or 20 nucleotides in length, or can comprise a single nucleotide with a phosphorus-based linkage, for example, a phosphoramidate or phosphodiester linkage. The biodegradable nucleic acid linker molecule can also comprise nucleic acid backbone, nucleic acid sugar, or nucleic acid base modifications.

The term "biodegradable" as used herein, refers to degradation in a biological system, for example, enzymatic degradation or chemical degradation.

The term "biologically active molecule" as used herein refers to compounds or molecules that are capable of eliciting or modifying a biological response in a system. Non-limiting examples of biologically active siNA molecules either alone or in combination with other molecules contemplated by the instant invention include therapeutically active molecules such as antibodies, cholesterol, hormones, antivirals, peptides, proteins, chemotherapeutics, small molecules, vitamins, co-factors, nucleosides, nucleotides, oligonucleotides, enzymatic nucleic acids, antisense nucleic acids, triplex forming oligonucleotides, 2,5-A chimeras, siNA, dsRNA, allozymes, aptamers, decoys and analogs thereof. Biologically active molecules of the invention also include molecules capable of modulating the pharmacokinetics and/or pharmacodynamics of other biologically active molecules, for example, lipids and polymers such as polyamines, polyamides, polyethylene glycol and other polyethers.

The term "phospholipid" as used herein, refers to a hydrophobic molecule comprising at least one phosphorus group. For example, a phospholipid can comprise a phosphorus-containing group and saturated or unsaturated alkyl group, optionally substituted with OH, COOH, oxo, amine, or substituted or unsubstituted aryl groups.

Therapeutic nucleic acid molecules (e.g., siNA molecules) delivered exogenously optimally are stable within cells until reverse transcription of the RNA has been modulated long enough to reduce the levels of the RNA transcript. The nucleic acid molecules are resistant to nucleases in order to function as effective intracellular therapeutic agents. Improvements in the chemical synthesis of nucleic acid molecules described in the instant invention and in the art have expanded the ability to modify nucleic acid molecules by introducing nucleotide modifications to enhance their nuclease stability as described above.

In yet another embodiment, siNA molecules having chemical modifications that maintain or enhance enzymatic activity of proteins involved in RNAi are provided. Such nucleic acids are also generally more resistant to nucleases than unmodified nucleic acids. Thus, in vitro and/or in vivo the activity should not be significantly lowered.

Use of the nucleic acid-based molecules of the invention will lead to better treatments by affording the possibility of combination therapies (e.g., multiple siNA molecules targeted to different genes; nucleic acid molecules coupled with known small molecule modulators; or intermittent treatment with combinations of molecules, including different motifs and/or other chemical or biological molecules). The treatment of subjects with siNA molecules can also include combinations of different types of nucleic acid molecules, such as enzymatic nucleic acid molecules (ribozymes), allozymes, antisense, 2,5-A oligoadenylate, decoys, and aptamers.

In another aspect a siNA molecule of the invention comprises one or more 5' and/or a 3'-cap structure, for example, on only the sense siNA strand, the antisense siNA strand, or both siNA strands.

By "cap structure" is meant chemical modifications, which have been incorporated at either terminus of the oligonucleotide (see, for example, Adamic et al., U.S. Pat. No. 5,998,203, incorporated by reference herein). These terminal modifications protect the nucleic acid molecule from exonuclease degradation, and may help in delivery and/or localization within a cell. The cap may be present at the 5'-terminus (5'-cap) or at the 3'-terminal (3'-cap) or may be present on both termini. In non-limiting examples, the 5'-cap includes, but is not limited to, glyceryl, inverted deoxy abasic residue (moiety); 4',5'-methylene nucleotide; 1-(beta-D-erythrofuranosyl) nucleotide, 4'-thio nucleotide; carbocyclic nucleotide; 1,5-anhydrohexitol nucleotide; L-nucleotides; alpha-nucleotides; modified base nucleotide; phosphorodithioate linkage; threo-pentofuranosyl nucleotide; acyclic 3',4'-seco nucleotide; acyclic 3,4-dihydroxybutyl nucleotide; acyclic 3,5-dihydroxypentyl nucleotide, 3'-3'-inverted nucleotide moiety; 3'-3'-inverted abasic moiety; 3'-2'-inverted nucleotide moiety; 3'-2'-inverted abasic moiety; 1,4-butanediol phosphate; 3'-phosphoramidate; hexylphosphate; aminohexyl phosphate; 3'-phosphate; 3'-phosphorothioate; phosphorodithioate; or bridging or non-bridging methylphosphonate moiety. Non-limiting examples of cap moieties are shown in FIG. 10.

Non-limiting examples of the 3'-cap include, but are not limited to, glyceryl, inverted deoxy abasic residue (moiety), 4',5'-methylene nucleotide; 1-(beta-D-erythrofuranosyl) nucleotide; 4'-thio nucleotide, carbocyclic nucleotide; 5'-amino-alkyl phosphate; 1,3-diamino-2-propyl phosphate; 3-aminopropyl phosphate; 6-aminohexyl phosphate; 1,2-aminododecyl phosphate; hydroxypropyl phosphate; 1,5-anhydrohexitol nucleotide; L-nucleotide; alpha-nucleotide; modified base nucleotide; phosphorodithioate; threo-pentofuranosyl nucleotide; acyclic 3',4'-seco nucleotide; 3,4-dihydroxybutyl nucleotide; 3,5-dihydroxypentyl nucleotide, 5'-5'-inverted nucleotide moiety; 5'-5'-inverted abasic moiety; 5'-phosphoramidate; 5'-phosphorothioate; 1,4-butanediol phosphate; 5'-amino; bridging and/or non-bridging 5'-phosphoramidate, phosphorothioate and/or phosphorodithioate, bridging or non bridging methylphosphonate and 5'-mercapto moieties (for more details see Beaucage and Iyer, 1993, *Tetrahedron* 49, 1925; incorporated by reference herein).

By the term "non-nucleotide" is meant any group or compound which can be incorporated into a nucleic acid chain in the place of one or more nucleotide units, including either sugar and/or phosphate substitutions, and allows the remaining bases to exhibit their enzymatic activity. The group or compound is abasic in that it does not contain a commonly recognized nucleotide base, such as adenosine, guanine, cytosine, uracil or thymine and therefore lacks a base at the 1'-position.

An "alkyl" group refers to a saturated aliphatic hydrocarbon, including straight-chain, branched-chain, and cyclic alkyl groups. Preferably, the alkyl group has 1 to 12 carbons. More preferably, it is a lower alkyl of from 1 to 7 carbons, more preferably 1 to 4 carbons. The alkyl group can be substituted or unsubstituted. When substituted the substituted group(s) is preferably, hydroxyl, cyano, alkoxy, $=O$, $=S$, $NO_2$ or $N(CH_3)_2$, amino, or SH. The term also includes alkenyl groups that are unsaturated hydrocarbon groups containing at least one carbon-carbon double bond, including straight-chain, branched-chain, and cyclic groups. Preferably, the alkenyl group has 1 to 12 carbons. More preferably, it is a lower alkenyl of from 1 to 7 carbons, more preferably 1 to 4 carbons. The alkenyl group may be substituted or unsubstituted. When substituted the substituted group(s) is preferably, hydroxyl, cyano, alkoxy, $=O$, $=S$, $NO_2$, halogen, $N(CH_3)_2$, amino, or SH. The term "alkyl" also includes alkynyl groups that have an unsaturated hydrocarbon group containing at least one carbon-carbon triple bond, including straight-chain, branched-chain, and cyclic groups. Preferably, the alkynyl group has 1 to 12 carbons. More preferably, it is a lower alkynyl of from 1 to 7 carbons, more preferably 1 to 4 carbons. The alkynyl group may be substituted or unsubstituted. When substituted the substituted group(s) is preferably, hydroxyl, cyano, alkoxy, $=O$, $=S$, $NO_2$ or $N(CH_3)_2$, amino or SH.

Such alkyl groups can also include aryl, alkylaryl, carbocyclic aryl, heterocyclic aryl, amide and ester groups. An "aryl" group refers to an aromatic group that has at least one ring having a conjugated pi electron system and includes carbocyclic aryl, heterocyclic aryl and biaryl groups, all of which may be optionally substituted. The preferred substituent(s) of aryl groups are halogen, trihalomethyl, hydroxyl, SH, OH, cyano, alkoxy, alkyl, alkenyl, alkynyl, and amino groups. An "alkylaryl" group refers to an alkyl group (as described above) covalently joined to an aryl group (as described above). Carbocyclic aryl groups are groups wherein the ring atoms on the aromatic ring are all carbon atoms. The carbon atoms are optionally substituted. Heterocyclic aryl groups are groups having from 1 to 3 heteroatoms as ring atoms in the aromatic ring and the remainder of the ring atoms are carbon atoms. Suitable heteroatoms include oxygen, sulfur, and nitrogen, and include furanyl, thienyl, pyridyl, pyrrolyl, N-lower alkyl pyrrolo, pyrimidyl, pyrazinyl, imidazolyl and the like, all optionally substituted. An "amide" refers to an —C(O)—NH—R, where R is either alkyl, aryl, alkylaryl or hydrogen. An "ester" refers to an —C(O)—OR', where R is either alkyl, aryl, alkylaryl or hydrogen.

By "nucleotide" as used herein is as recognized in the art to include natural bases (standard), and modified bases well known in the art. Such bases are generally located at the 1' position of a nucleotide sugar moiety. Nucleotides generally comprise a base, sugar and a phosphate group. The nucleotides can be unmodified or modified at the sugar, phosphate and/or base moiety, (also referred to interchangeably as nucleotide analogs, modified nucleotides, non-natural nucleotides, non-standard nucleotides and other; see, for example, Usman and McSwiggen, supra; Eckstein et al., International PCT Publication No. WO 92/07065; Usman et al., International PCT Publication No. WO 93/15187; Uhlman & Peyman, supra, all are hereby incorporated by reference herein). There are several examples of modified nucleic acid bases known in the art as summarized by Limbach et al., 1994, *Nucleic Acids Res.* 22, 2183. Some of the non-limiting examples of base modifications that can be introduced into nucleic acid molecules include, inosine, purine, pyridin-4-one, pyridin-2-one, phenyl, pseudouracil, 2,4,6-trimethoxy benzene, 3-methyl uracil, dihydrouridine, naphthyl, aminophenyl, 5-alkylcytidines (e.g., 5-methylcytidine), 5-alkyluridines (e.g., ribothymidine), 5-halouridine (e.g., 5-bromouridine) or 6-azapyrimidines or 6-alkylpyrimidines (e.g. 6-methyluridine), propyne, and others (Burgin et al., 1996, *Biochemistry,* 35, 14090; Uhlman & Peyman, supra). By "modified bases" in this aspect is meant nucleotide bases other than adenine, guanine, cytosine and uracil at 1' position or their equivalents.

In one embodiment, the invention features modified siNA molecules, with phosphate backbone modifications comprising one or more phosphorothioate, phosphorodithioate, methylphosphonate, phosphotriester, morpholino, amidate carbamate, carboxymethyl, acetamidate, polyamide, sulfonate, sulfonamide, sulfamate, formacetal, thioformacetal, and/or alkylsilyl, substitutions. For a review of oligonucleotide backbone modifications, see Hunziker and Leumann, 1995, *Nucleic Acid Analogues: Synthesis and Properties*, in *Modern Synthetic Methods*, VCH, 331-417, and Mesmaeker et al., 1994, *Novel Backbone Replacements for Oligonucleotides, in Carbohydrate Modifications in Antisense Research*, ACS, 24-39.

By "abasic" is meant sugar moieties lacking a nucleobase or having a hydrogen atom (H) or other non-nucleobase chemical groups in place of a nucleobase at the 1' position of the sugar moiety, see for example Adamic et al., U.S. Pat. No. 5,998,203. In one embodiment, an abasic moiety of the invention is a ribose, deoxyribose, or dideoxyribose sugar.

By "unmodified nucleoside" is meant one of the bases adenine, cytosine, guanine, thymine, or uracil joined to the 1' carbon of β-D-ribo-furanose.

By "modified nucleoside" is meant any nucleotide base which contains a modification in the chemical structure of an unmodified nucleotide base, sugar and/or phosphate. Non-limiting examples of modified nucleotides are shown by Formulae I-VII and/or other modifications described herein.

In connection with 2'-modified nucleotides as described for the present invention, by "amino" is meant 2'—$NH_2$ or 2'-O—$NH_2$, which can be modified or unmodified. Such modified groups are described, for example, in Eckstein et al., U.S. Pat. No. 5,672,695 and Matulic-Adamic et al., U.S. Pat. No. 6,248,878, which are both incorporated by reference in their entireties.

Various modifications to nucleic acid siNA structure can be made to enhance the utility of these molecules. Such modifications will enhance shelf-life, half-life in vitro, stability, and ease of introduction of such oligonucleotides to the target site, e.g., to enhance penetration of cellular membranes, and confer the ability to recognize and bind to targeted cells.

Administration of Nucleic Acid Molecules

A siNA molecule of the invention can be adapted for use to treat, prevent, inhibit, or reduce HCV infection, liver failure, hepatocellular carcinoma, cirrhosis and/or any other trait, disease or condition that is related to or will respond to the levels of HCV in a cell or tissue, alone or in combination with other therapies. In one embodiment, the siNA molecules of the invention and formulations or compositions thereof are administered to the liver as is generally known in the art (see for example Wen et al., 2004, *World J. Gastroenterol.*, 10, 244-9; Murao et al., 2002, *Pharm Res.*, 19, 1808-14; Liu et al., 2003, *Gene Ther.*, 10, 180-7; Hong et al., 2003, *J Pharm Pharmacol.*, 54, 51-8; Herrmann et al., 2004, *Arch Virol.*, 149, 1611-7; and Matsuno et al., 2003, *Gene Ther.*, 10, 1559-66).

In one embodiment, a siNA composition of the invention can comprise a delivery vehicle, including liposomes, for administration to a subject, carriers and diluents and their salts, and/or can be present in pharmaceutically acceptable formulations. Methods for the delivery of nucleic acid molecules are described in Akhtar et al., 1992, *Trends Cell Bio.*, 2, 139; *Delivery Strategies for Antisense Oligonucleotide Therapeutics*, ed. Akhtar, 1995, Maurer et al., 1999, *Mol. Membr. Biol.*, 16, 129-140; Hofland and Huang, 1999, *Handb. Exp. Pharmacol.*, 137, 165-192; and Lee et al., 2000, *ACS Symp. Ser.*, 752, 184-192, all of which are incorporated herein by reference. Beigelman et al., U.S. Pat. No. 6,395,713 and Sullivan et al., PCT WO 94/02595 further describe the general methods for delivery of nucleic acid molecules. These protocols can be utilized for the delivery of virtually any nucleic acid molecule. Nucleic acid molecules can be administered to cells by a variety of methods known to those of skill in the art, including, but not restricted to, encapsulation in liposomes, by iontophoresis, or by incorporation into other vehicles, such as biodegradable polymers, hydrogels, cyclodextrins (see for example Gonzalez et al., 1999, *Bioconjugate Chem.*, 10, 1068-1074; Wang et al., International PCT publication Nos. WO 03/47518 and WO 03/46185), poly(lactic-co-glycolic)acid (PLGA) and PLCA microspheres (see for example U.S. Pat. No. 6,447,796 and US Patent Application Publication No. US 2002130430), biodegradable nanocapsules, and bioadhesive microspheres, or by proteinaceous vectors (O'Hare and Normand, International PCT Publication No. WO 00/53722). In another embodiment, the nucleic acid molecules of the invention can also be formulated or complexed with polyethyleneimine and derivatives thereof, such as polyethyleneimine-polyethyleneglycol-N-acetylgalactosamine (PEI-PEG-GAL) or polyethyleneimine-polyethyleneglycol-tri-N-acetylgalactosamine (PEI-PEG-triGAL) derivatives. In one embodiment, the nucleic acid molecules of the invention are formulated as described in United States Patent Application Publication No. 20030077829, incorporated by reference herein in its entirety.

In one embodiment, a siNA molecule of the invention is formulated as a composition described in U.S. Provisional patent application No. 60/678,531 and in related U.S. Provisional patent application No. 60/703,946, filed Jul. 29, 2005, U.S. Provisional patent application No. 60/737,024, filed Nov. 15, 2005, and U.S. Ser. No. 11/353,630, filed Feb. 14, 2006 (Vargeese et al.), all of which are incorporated by reference herein in their entirety. Such siNA formulations are generally referred to as "lipid nucleic acid particles" (LNP). In one embodiment, a siNA molecule of the invention is formulated with one or more LNP compositions described herein in Table VI (see also U.S. Ser. No. 11/353,630 and U.S. Ser. No.11/586,102 incorporated by reference herein).

In one embodiment, the siNA molecules of the invention and formulations or compositions thereof are administered to tissues and cells as is described in US 2006/0062758; US 2006/0014289; and US 2004/0077540.

In one embodiment, a siNA molecule of the invention is complexed with membrane disruptive agents such as those described in U.S. Patent Application Publication No. 20010007666, incorporated by reference herein in its entirety including the drawings. In another embodiment, the membrane disruptive agent or agents and the siNA molecule are also complexed with a cationic lipid or helper lipid molecule, such as those lipids described in U.S. Pat. No. 6,235,310, incorporated by reference herein in its entirety including the drawings.

In one embodiment, a siNA molecule of the invention is complexed with delivery systems as described in U.S. Patent Application Publication No. 2003077829 and International PCT Publication Nos. WO 00/03683 and WO 02/087541, all incorporated by reference herein in their entirety including the drawings.

In one embodiment, the nucleic acid molecules of the invention are administered to skeletal tissues (e.g., bone, cartilage, tendon, ligament) or bone metastatic tumors via atelocollagen complexation or conjugation (see for example Takeshita et al., 2005, *PNAS*, 102, 12177-12182). Therefore, in one embodiment, the instant invention features one or more dsiNA molecules as a composition complexed with atelocollagen. In another embodiment, the instant invention features one or more siNA molecules conjugated to atelocollagen via a linker as described herein or otherwise known in the art.

In one embodiment, the nucleic acid molecules of the invention and formulations thereof (e.g., LNP formulations of double stranded nucleic acid molecules of the invention) are administered via pulmonary delivery, such as by inhalation of an aerosol or spray dried formulation administered by an inhalation device or nebulizer, providing rapid local uptake of the nucleic acid molecules into relevant pulmonary tissues. Solid particulate compositions containing respirable dry particles of micronized nucleic acid compositions can be prepared by grinding dried or lyophilized nucleic acid compositions, and then passing the micronized composition through, for example, a 400 mesh screen to break up or separate out large agglomerates. A solid particulate composition comprising the nucleic acid compositions of the invention can optionally contain a dispersant which serves to facilitate the formation of an aerosol as well as other therapeutic compounds. A suitable dispersant is lactose, which can be blended with the nucleic acid compound in any suitable ratio, such as a 1 to 1 ratio by weight.

Aerosols of liquid particles comprising a nucleic acid composition of the invention can be produced by any suitable means, such as with a nebulizer (see for example U.S. Pat. No. 4,501,729). Nebulizers are commercially available devices which transform solutions or suspensions of an active ingredient into a therapeutic aerosol mist either by means of acceleration of a compressed gas, typically air or oxygen, through a narrow venturi orifice or by means of ultrasonic agitation. Suitable formulations for use in nebulizers comprise the active ingredient in a liquid carrier in an amount of up to 40% w/w preferably less than 20% w/w of the formulation. The carrier is typically water or a dilute aqueous alcoholic solution, preferably made isotonic with body fluids by the addition of, for example, sodium chloride or other suitable salts. Optional additives include preservatives if the formulation is not prepared sterile, for example, methyl hydroxybenzoate, anti-oxidants, flavorings, volatile oils, buffering agents and emulsifiers and other formulation surfactants. The aerosols of solid particles comprising the active composition and surfactant can likewise be produced with any solid particulate aerosol generator. Aerosol generators for administering solid particulate therapeutics to a subject produce particles which are respirable, as explained above, and generate a volume of aerosol containing a predetermined metered dose of a therapeutic composition at a rate suitable for human administration.

In one embodiment, a solid particulate aerosol generator of the invention is an insufflator. Suitable formulations for administration by insufflation include finely comminuted powders which can be delivered by means of an insufflator. In the insufflator, the powder, e.g., a metered dose thereof effective to carry out the treatments described herein, is contained in capsules or cartridges, typically made of gelatin or plastic, which are either pierced or opened in situ and the powder delivered by air drawn through the device upon inhalation or by means of a manually-operated pump. The powder employed in the insufflator consists either solely of the active ingredient or of a powder blend comprising the active ingredient, a suitable powder diluent, such as lactose, and an optional surfactant. The active ingredient typically comprises from 0.1 to 100 w/w of the formulation. A second type of illustrative aerosol generator comprises a metered dose inhaler. Metered dose inhalers are pressurized aerosol dispensers, typically containing a suspension or solution formulation of the active ingredient in a liquified propellant. During use these devices discharge the formulation through a valve adapted to deliver a metered volume to produce a fine particle spray containing the active ingredient. Suitable propellants include certain chlorofluorocarbon compounds, for example, dichlorodifluoromethane, trichlorofluoromethane, dichlorotetrafluoroethane and mixtures thereof. The formulation can additionally contain one or more co-solvents, for example, ethanol, emulsifiers and other formulation surfactants, such as oleic acid or sorbitan trioleate, anti-oxidants and suitable flavoring agents. Other methods for pulmonary delivery are described in, for example US Patent Application No. 20040037780, and U.S. Pat. Nos. 6,592,904; 6,582,728; 6,565,885, all incorporated by reference herein.

In one embodiment, the siNA and LNP compositions and formulations provided herein for use in pulmonary delivery further comprise one or more surfactants. Suitable surfactants or surfactant components for enhancing the uptake of the compositions of the invention include synthetic and natural as well as full and truncated forms of surfactant protein A, surfactant protein B, surfactant protein C, surfactant protein D and surfactant Protein E, di-saturated phosphatidylcholine (other than dipalmitoyl), dipalmitoylphosphatidylcholine, phosphatidylcholine, phosphatidylglycerol, phosphatidylinositol, phosphatidylethanolamine, phosphatidylserine; phosphatidic acid, ubiquinones, lysophosphatidylethanolamine, lysophosphatidylcholine, palmitoyl-lysophosphatidylcholine, dehydroepiandrosterone, dolichols, sulfatidic acid, glycerol-3-phosphate, dihydroxyacetone phosphate, glycerol, glycero-3-phosphocholine, dihydroxyacetone, palmitate, cytidine diphosphate (CDP) diacylglycerol, CDP choline, choline, choline phosphate; as well as natural and artificial lamelar bodies which are the natural carrier vehicles for the components of surfactant, omega-3 fatty acids, polyenic acid, polyenoic acid, lecithin, palmitinic acid, non-ionic block copolymers of ethylene or propylene oxides, polyoxypropylene, monomeric and polymeric, polyoxyethylene, monomeric and polymeric, poly (vinyl amine) with dextran and/or alkanoyl side chains, Brij 35, Triton X-100 and synthetic surfactants ALEC, Exosurf, Survan and Atovaquone, among others. These surfactants may be used either as single or part of a multiple component surfactant in a formulation, or as covalently bound additions to the 5' and/or 3' ends of the nucleic acid component of a pharmaceutical composition herein.

The composition of the present invention may be administered into the respiratory system as a formulation including particles of respirable size, e.g. particles of a size sufficiently small to pass through the nose, mouth and larynx upon inhalation and through the bronchi and alveoli of the lungs. In general, respirable particles range from about 0.5 to 10 microns in size. Particles of non-respirable size which are included in the aerosol tend to deposit in the throat and be swallowed, and the quantity of non-respirable particles in the aerosol is thus minimized. For nasal administration, a particle size in the range of 10-500 um is preferred to ensure retention in the nasal cavity.

In one embodiment, the siNA molecules of the invention and formulations or compositions thereof are administered to the liver as is generally known in the art (see for example Wen et al., 2004, *World J. Gastroenterol.*, 10, 244-9; Murao et al., 2002, *Pharm Res.*, 19, 1808-14; Liu et al., 2003, *gene Ther.*, 10, 180-7; Hong et al., 2003, *J Pharm Pharmacol.*, 54, 51-8; Herrmann et al., 2004, *Arch Virol.*, 149, 1611-7; and Matsuno et al., 2003, *gene Ther.*, 10, 1559-66).

In one embodiment, the invention features the use of methods to deliver the nucleic acid molecules of the instant invention to the central nervous system and/or peripheral nervous system. Experiments have demonstrated the efficient in vivo uptake of nucleic acids by neurons. As an example of local administration of nucleic acids to nerve cells, Sommer et al., 1998, *Antisense Nuc. Acid Drug Dev.*, 8, 75, describe a study in which a 15 mer phosphorothioate antisense nucleic acid molecule to c-fos is administered to rats via microinjection into the brain. Antisense molecules labeled with tetramethylrhodamine-isothiocyanate (TRITC) or fluorescein isothiocyanate (FITC) were taken up by exclusively by neurons thirty minutes post-injection. A diffuse cytoplasmic staining and nuclear staining was observed in these cells. As an example of systemic administration of nucleic acid to nerve cells, Epa et al., 2000, *Antisense Nuc. Acid Drug Dev.*, 10, 469, describe an in vivo mouse study in which beta-cyclodextrin-adamantane-oligonucleotide conjugates were used to target the p75 neurotrophin receptor in neuronally differentiated PC12 cells. Following a two week course of IP administration, pronounced uptake of p75 neurotrophin receptor antisense was observed in dorsal root ganglion (DRG) cells. In addition, a marked and consistent down-regulation of p75 was observed in DRG neurons. Additional approaches to the targeting of nucleic acid to neurons are described in Broaddus et al., 1998, *J. Neurosurg.*, 88(4), 734; Karle et al., 1997, *Eur. J. Pharmocol.*, 340(2/3), 153; Bannai et al., 1998, *Brain Research*, 784 (1,2), 304; Rajakumar et al., 1997, *Synapse*, 26(3), 199; Wu-pong et al., 1999, *BioPharm*, 12(1), 32; Bannai et al., 1998, *Brain Res. Protoc.*, 3(1), 83; Sirnantov et al., 1996, *Neuroscience*, 74(1), 39. Nucleic acid molecules of the invention are therefore amenable to delivery to and uptake by cells that express repeat expansion allelic variants for modulation of RE gene expression. The delivery of nucleic acid molecules of the invention, targeting RE is provided by a variety of different strategies. Traditional approaches to CNS delivery that can be used include, but are not limited to, intrathecal and intracerebroventricular administration, implantation of catheters and pumps, direct injection or perfusion at the site of injury or lesion, injection into the brain arterial system, or by chemical or osmotic opening of the blood-brain barrier. Other approaches can include the use of various transport and carrier systems, for example though the use of conjugates and biodegradable polymers. Furthermore, gene therapy approaches, for example as described in Kaplitt et al., U.S. Pat. No. 6,180,613 and Davidson, WO 04/013280, can be used to express nucleic acid molecules in the CNS.

In one embodiment, siNA compounds and compositions of the invention are administered either systemically or locally about every 1-50 weeks (e.g., about every 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50 weeks), alone or in combination with other compounds and/or therapies herein. In one embodiment, siNA compounds and compositions of the invention are administered systemically (e.g., via intravenous, subcutaneous, intramuscular, infusion, pump, implant etc.) about every 1-50 weeks (e.g., about every 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50 weeks), alone or in combination with other compounds and/or therapies described herein and/or otherwise known in the art.

In one embodiment, a siNA molecule of the invention is administered iontophoretically, for example to a particular organ or compartment (e.g., liver, tumor, CNS etc.). Non-limiting examples of iontophoretic delivery are described in, for example, WO 03/043689 and WO 03/030989, which are incorporated by reference in their entireties herein.

In one embodiment, the siNA molecules of the invention and formulations or compositions thereof are administered to the liver as is generally known in the art (see for example Wen et al., 2004, *World J. Gastroenterol.*, 10, 244-9; Murao et al., 2002, *Pharm Res.*, 19, 1808-14; Liu et al., 2003, *Gene Ther.*, 10, 180-7; Hong et al., 2003, *J Pharm Pharmacol.*, 54, 51-8; Herrmann et al., 2004, *Arch Virol.*, 149, 1611-7; and Matsuno et al., 2003, *Gene Ther.*, 10, 1559-66).

In one embodiment, the invention features the use of methods to deliver the nucleic acid molecules of the instant invention to hematopoietic cells, including monocytes and lymphocytes. These methods are described in detail by Hartmann et al., 1998, *J. Phamacol. Exp. Ther.*, 285(2), 920-928; Kronenwett et al., 1998, *Blood*, 91(3), 852-862; Filion and Phillips, 1997, *Biochim. Biophys. Acta.*, 1329(2), 345-356; Ma and Wei, 1996, *Leuk. Res.*, 20(11/12), 925-930; and Bongartz et al., 1994, *Nucleic Acids Research*, 22(22), 4681-8. Such methods, as described above, include the use of free oligonucleotide, cationic lipid formulations, liposome formulations including pH sensitive liposomes and immunoliposomes, and bioconjugates including oligonucleotides conjugated to fusogenic peptides, for the transfection of hematopoietic cells with oligonucleotides.

In one embodiment, the siNA molecules of the invention and formulations or compositions thereof are administered directly or topically (e.g., locally) to the dermis or follicles as is generally known in the art (see for example Brand, 2001, *Curr. Opin. Mol. Ther.*, 3, 244-8; Regnier et al., 1998, *J. Drug Target*, 5, 275-89; Kanikkannan, 2002, *BioDrugs*, 16, 339-47; Wraight et al., 2001, *Pharmacol. Ther.*, 90, 89-104; and Preat and Dujardin, 2001, STP PharmaSciences, 11, 57-68). In one embodiment, the siNA molecules of the invention and formulations or compositions thereof are administered directly or topically using a hydroalcoholic gel formulation comprising an alcohol (e.g., ethanol or isopropanol), water, and optionally including additional agents such isopropyl myristate and carbomer 980.

In one embodiment, delivery systems of the invention include, for example, aqueous and nonaqueous gels, creams, multiple emulsions, microemulsions, liposomes, ointments, aqueous and nonaqueous solutions, lotions, aerosols, hydrocarbon bases and powders, and can contain excipients such as solubilizers, permeation enhancers (e.g., fatty acids, fatty acid esters, fatty alcohols and amino acids), and hydrophilic polymers (e.g., polycarbophil and polyvinylpyrolidone). In one embodiment, the pharmaceutically acceptable carrier is a liposome or a transdermal enhancer. Examples of liposomes which can be used in this invention include the following: (1) CellFectin, 1:1.5 (M/M) liposome formulation of the cationic lipid N,NI,NII,NIII-tetramethyl-N,NI,NII,NIII-tetrapalmit-y-spermine and dioleoyl phosphatidylethanolamine (DOPE) (GIBCO BRL); (2) Cytofectin GSV, 2:1 (M/M) liposome formulation of a cationic lipid and DOPE (Glen Research); (3) DOTAP (N-[1-(2,3-dioleoyloxy)-N,N,N-tri-methyl-ammoniummethylsulfate) (Boehringer Manheim); and (4) Lipofectamine, 3:1 (M/M) liposome formulation of the polycationic lipid DOSPA and the neutral lipid DOPE (GIBCO BRL).

In one embodiment, delivery systems of the invention include patches, tablets, suppositories, pessaries, gels and creams, and can contain excipients such as solubilizers and enhancers (e.g., propylene glycol, bile salts and amino acids), and other vehicles (e.g., polyethylene glycol, fatty acid esters and derivatives, and hydrophilic polymers such as hydroxypropylmethylcellulose and hyaluronic acid).

In one embodiment, siNA molecules of the invention are formulated or complexed with polyethylenimine (e.g., linear or branched PEI) and/or polyethylenimine derivatives, including for example grafted PEIs such as galactose PEI, cholesterol PEI, antibody derivatized PEI, and polyethylene glycol PEI (PEG-PEI) derivatives thereof (see for example Ogris et al., 2001, *AAPA PharmSci*, 3, 1-11; Furgeson et al., 2003, Bioconjugate Chem., 14, 840-847; Kunath et al., 2002, Pharmaceutical Research, 19, 810-817; Choi et al., 2001, Bull. Korean Chem. Soc., 22, 46-52; Bettinger et al., 1999, Bioconjugate Chem., 10, 558-561; Peterson et al., 2002, Bioconjugate Chem., 13, 845-854; Erbacher et al., 1999, Journal of Gene Medicine Preprint, 1, 1-18; Godbey et al., 1999., PNAS USA, 96, 5177-5181; Godbey et al., 1999, Journal of Controlled Release, 60, 149-160; Diebold et al., 1999, Journal of Biological Chemistry, 274, 19087-19094; Thomas and Klibanov, 2002, PNAS USA, 99, 14640-14645; and Sagara, U.S. Pat. No. 6,586,524, incorporated by reference herein.

In one embodiment, a siNA molecule of the invention comprises a bioconjugate, for example a nucleic acid conjugate as described in Vargeese et al., U.S. Ser. No. 10/427,160, filed Apr. 30, 2003; U.S. Pat. Nos. 6,528,631; 6,335,434; 6,235,886; 6,153,737; 5,214,136; 5,138,045, all incorporated by reference herein.

Thus, the invention features a pharmaceutical composition comprising one or more nucleic acid(s) of the invention in an acceptable carrier, such as a stabilizer, buffer, and the like. The polynucleotides of the invention can be administered (e.g., RNA, DNA or protein) and introduced to a subject by any standard means, with or without stabilizers, buffers, and the like, to form a pharmaceutical composition. When it is desired to use a liposome delivery mechanism, standard protocols for formation of liposomes can be followed. The compositions of the present invention can also be formulated and used as creams, gels, sprays, oils and other suitable compositions for topical, dermal, or transdermal administration as is known in the art.

The present invention also includes pharmaceutically acceptable formulations of the compounds described. These formulations include salts of the above compounds, e.g., acid addition salts, for example, salts of hydrochloric, hydrobromic, acetic acid, and benzene sulfonic acid.

A pharmacological composition or formulation refers to a composition or formulation in a form suitable for administration, e.g., systemic or local administration, into a cell or subject, including for example a human. Suitable forms, in part, depend upon the use or the route of entry, for example oral, transdermal, or by injection. Such forms should not prevent the composition or formulation from reaching a target cell (i.e., a cell to which the negatively charged nucleic acid is desirable for delivery). For example, pharmacological compositions injected into the blood stream should be soluble. Other factors are known in the art, and include considerations such as toxicity and forms that prevent the composition or formulation from exerting its effect.

In one embodiment, siNA molecules of the invention are administered to a subject by systemic administration in a pharmaceutically acceptable composition or formulation. By "systemic administration" is meant in vivo systemic absorption or accumulation of drugs in the blood stream followed by distribution throughout the entire body. Administration routes that lead to systemic absorption include, without limitation: intravenous, subcutaneous, portal vein, intraperitoneal, inhalation, oral, intrapulmonary and intramuscular. Each of these administration routes exposes the siNA molecules of the invention to an accessible diseased tissue. The rate of entry of a drug into the circulation has been shown to be a function of molecular weight or size. The use of a liposome or other drug carrier comprising the compounds of the instant invention can potentially localize the drug, for example, in certain tissue types, such as the tissues of the reticular endothelial system (RES). A liposome formulation that can facilitate the association of drug with the surface of cells, such as, lymphocytes and macrophages is also useful. This approach can provide enhanced delivery of the drug to target cells by taking advantage of the specificity of macrophage and lymphocyte immune recognition of abnormal cells.

By "pharmaceutically acceptable formulation" or "pharmaceutically acceptable composition" is meant, a composition or formulation that allows for the effective distribution of the nucleic acid molecules of the instant invention in the physical location most suitable for their desired activity. Non-limiting examples of agents suitable for formulation with the nucleic acid molecules of the instant invention include: P-glycoprotein inhibitors (such as Pluronic P85); biodegradable polymers, such as poly (DL-lactide-coglycolide) microspheres for sustained release delivery (Emerich, D F et al, 1999, *Cell Transplant*, 8, 47-58); and loaded nanoparticles, such as those made of polybutylcyanoacrylate. Other non-limiting examples of delivery strategies for the nucleic acid molecules of the instant invention include material described in Boado et al., 1998, *J. Pharm. Sci.*, 87, 1308-1315; Tyler et al., 1999, *FEBS Lett.*, 421, 280-284; Pardridge et al., 1995, *PNAS USA.*, 92, 5592-5596; Boado, 1995, *Adv. Drug Delivery Rev.*, 15, 73-107; Aldrian-Herrada et al., 1998, *Nucleic Acids Res.*, 26, 4910-4916; and Tyler et al., 1999, *PNAS USA.*, 96, 7053-7058.

The invention also features the use of a composition comprising surface-modified liposomes containing poly (ethylene glycol) lipids (PEG-modified, or long-circulating liposomes or stealth liposomes) and nucleic acid molecules of the invention. These formulations offer a method for increasing the accumulation of drugs (e.g., siNA) in target tissues. This class of drug carriers resists opsonization and elimination by the mononuclear phagocytic system (MPS or RES), thereby enabling longer blood circulation times and enhanced tissue exposure for the encapsulated drug (Lasic et al. *Chem. Rev.* 1995, 95, 2601-2627; Ishiwata et al., *Chem. Pharm. Bull.* 1995, 43, 1005-1011). Such liposomes have been shown to accumulate selectively in tumors, presumably by extravasation and capture in the neovascularized target tissues (Lasic et al., Science 1995, 267, 1275-1276; Oku et al., 1995, *Biochim. Biophys. Acta,* 1238, 86-90). The long-circulating liposomes enhance the pharmacokinetics and pharmacodynamics of DNA and RNA, particularly compared to conventional cationic liposomes which are known to accumulate in tissues of the MPS (Liu et al., *J. Biol. Chem.* 1995, 42, 24864-24870; Choi et al., International PCT Publication No. WO 96/10391; Ansell et al., International PCT Publication No. WO 96/10390; Holland et al., International PCT Publication No. WO 96/10392). Long-circulating liposomes are also likely to protect drugs from nuclease degradation to a greater extent compared to cationic liposomes, based on their ability to avoid accumulation in metabolically aggressive MPS tissues such as the liver and spleen.

In one embodiment, a liposomal formulation of the invention comprises a double stranded nucleic acid molecule of the invention (e.g, siNA) formulated or complexed with compounds and compositions described in U.S. Pat. Nos. 6,858,224; 6,534,484; 6,287,591; 6,835,395; 6,586,410; 6,858,225; 6,815,432; 6,586,001; 6,120,798; 6,977,223; 6,998,115; 5,981,501; 5,976,567; 5,705,385; US 2006/0019912; US 2006/0019258; US 2006/0008909; US 2005/0255153; US 2005/0079212; US 2005/0008689; US 2003/0077829, US 2005/0064595, US 2005/0175682, US 2005/0118253; US 2004/0071654; US 2005/0244504; US 2005/0265961 and US 2003/0077829, all of which are incorporated by reference herein in their entirety.

The present invention also includes compositions prepared for storage or administration that include a pharmaceutically effective amount of the desired compounds in a pharmaceutically acceptable carrier or diluent. Acceptable carriers or diluents for therapeutic use are well known in the pharmaceutical art, and are described, for example, in *Remington's*

*Pharmaceutical Sciences*, Mack Publishing Co. (A. R. Gennaro edit. 1985), hereby incorporated by reference herein. For example, preservatives, stabilizers, dyes and flavoring agents can be provided. These include sodium benzoate, sorbic acid and esters of p-hydroxybenzoic acid. In addition, antioxidants and suspending agents can be used.

A pharmaceutically effective dose is that dose required to prevent, inhibit the occurrence, or treat (alleviate a symptom to some extent, preferably all of the symptoms) of a disease state. The pharmaceutically effective dose depends on the type of disease, the composition used, the route of administration, the type of mammal being treated, the physical characteristics of the specific mammal under consideration, concurrent medication, and other factors that those skilled in the medical arts will recognize. Generally, an amount between 0.1 mg/kg and 100 mg/kg body weight/day of active ingredients is administered dependent upon potency of the negatively charged polymer.

The nucleic acid molecules of the invention and formulations thereof can be administered orally, topically, parenterally, by inhalation or spray, or rectally in dosage unit formulations containing conventional non-toxic pharmaceutically acceptable carriers, adjuvants and/or vehicles. The term parenteral as used herein includes percutaneous, subcutaneous, intravascular (e.g., intravenous), intramuscular, or intrathecal injection or infusion techniques and the like. In addition, there is provided a pharmaceutical formulation comprising a nucleic acid molecule of the invention and a pharmaceutically acceptable carrier. One or more nucleic acid molecules of the invention can be present in association with one or more non-toxic pharmaceutically acceptable carriers and/or diluents and/or adjuvants, and if desired other active ingredients. The pharmaceutical compositions containing nucleic acid molecules of the invention can be in a form suitable for oral use, for example, as tablets, troches, lozenges, aqueous or oily suspensions, dispersible powders or granules, emulsion, hard or soft capsules, or syrups or elixirs.

Compositions intended for oral use can be prepared according to any method known to the art for the manufacture of pharmaceutical compositions and such compositions can contain one or more such sweetening agents, flavoring agents, coloring agents or preservative agents in order to provide pharmaceutically elegant and palatable preparations. Tablets contain the active ingredient in admixture with non-toxic pharmaceutically acceptable excipients that are suitable for the manufacture of tablets. These excipients can be, for example, inert diluents; such as calcium carbonate, sodium carbonate, lactose, calcium phosphate or sodium phosphate; granulating and disintegrating agents, for example, corn starch, or alginic acid; binding agents, for example starch, gelatin or acacia; and lubricating agents, for example magnesium stearate, stearic acid or talc. The tablets can be uncoated or they can be coated by known techniques. In some cases such coatings can be prepared by known techniques to delay disintegration and absorption in the gastrointestinal tract and thereby provide a sustained action over a longer period. For example, a time delay material such as glyceryl monosterate or glyceryl distearate can be employed.

Formulations for oral use can also be presented as hard gelatin capsules wherein the active ingredient is mixed with an inert solid diluent, for example, calcium carbonate, calcium phosphate or kaolin, or as soft gelatin capsules wherein the active ingredient is mixed with water or an oil medium, for example peanut oil, liquid paraffin or olive oil.

Aqueous suspensions contain the active materials in a mixture with excipients suitable for the manufacture of aqueous suspensions. Such excipients are suspending agents, for example sodium carboxymethylcellulose, methylcellulose, hydropropyl-methylcellulose, sodium alginate, polyvinylpyrrolidone, gum tragacanth and gum acacia; dispersing or wetting agents can be a naturally-occurring phosphatide, for example, lecithin, or condensation products of an alkylene oxide with fatty acids, for example polyoxyethylene stearate, or condensation products of ethylene oxide with long chain aliphatic alcohols, for example heptadecaethyleneoxycetanol, or condensation products of ethylene oxide with partial esters derived from fatty acids and a hexitol such as polyoxyethylene sorbitol monooleate, or condensation products of ethylene oxide with partial esters derived from fatty acids and hexitol anhydrides, for example polyethylenesorbitan monooleate. The aqueous suspensions can also contain one or more preservatives, for example ethyl, or n-propyl p-hydroxybenzoate, one or more coloring agents, one or more flavoring agents, and one or more sweetening agents, such as sucrose or saccharin.

Oily suspensions can be formulated by suspending the active ingredients in a vegetable oil, for example arachis oil, olive oil, sesame oil or coconut oil, or in a mineral oil such as liquid paraffin. The oily suspensions can contain a thickening agent, for example beeswax, hard paraffin or cetyl alcohol. Sweetening agents and flavoring agents can be added to provide palatable oral preparations. These compositions can be preserved by the addition of an anti-oxidant such as ascorbic acid Dispersible powders and granules suitable for preparation of an aqueous suspension by the addition of water provide the active ingredient in admixture with a dispersing or wetting agent, suspending agent and one or more preservatives. Suitable dispersing or wetting agents or suspending agents are exemplified by those already mentioned above. Additional excipients, for example sweetening, flavoring and coloring agents, can also be present.

Pharmaceutical compositions of the invention can also be in the form of oil-in-water emulsions. The oily phase can be a vegetable oil or a mineral oil or mixtures of these. Suitable emulsifying agents can be naturally-occurring gums, for example gum acacia or gum tragacanth, naturally-occurring phosphatides, for example soy bean, lecithin, and esters or partial esters derived from fatty acids and hexitol, anhydrides, for example sorbitan monooleate, and condensation products of the said partial esters with ethylene oxide, for example polyoxyethylene sorbitan monooleate. The emulsions can also contain sweetening and flavoring agents.

Syrups and elixirs can be formulated with sweetening agents, for example glycerol, propylene glycol, sorbitol, glucose or sucrose. Such formulations can also contain a demulcent, a preservative and flavoring and coloring agents. The pharmaceutical compositions can be in the form of a sterile injectable aqueous or oleaginous suspension. This suspension can be formulated according to the known art using those suitable dispersing or wetting agents and suspending agents that have been mentioned above. The sterile injectable preparation can also be a sterile injectable solution or suspension in a non-toxic parentally acceptable diluent or solvent, for example as a solution in 1,3-butanediol. Among the acceptable vehicles and solvents that can be employed are water, Ringer's solution and isotonic sodium chloride solution. In addition, sterile, fixed oils are conventionally employed as a solvent or suspending medium. For this purpose, any bland fixed oil can be employed including synthetic mono- or diglycerides. In addition, fatty acids such as oleic acid find use in the preparation of injectables.

The nucleic acid molecules of the invention can also be administered in the form of suppositories, e.g., for rectal administration of the drug. These compositions can be prepared by mixing the drug with a suitable non-irritating excipient that is solid at ordinary temperatures but liquid at the rectal temperature and will therefore melt in the rectum to release the drug. Such materials include cocoa butter and polyethylene glycols.

Nucleic acid molecules of the invention can be administered parenterally in a sterile medium. The drug, depending on the vehicle and concentration used, can either be suspended or dissolved in the vehicle. Advantageously, adjuvants such as local anesthetics, preservatives and buffering agents can be dissolved in the vehicle.

Dosage levels of the order of from about 0.1 mg to about 140 mg per kilogram of body weight per day are useful in the treatment of the above-indicated conditions (about 0.5 mg to about 7 g per subject per day). The amount of active ingredient that can be combined with the carrier materials to produce a single dosage form varies depending upon the host treated and the particular mode of administration. Dosage unit forms generally contain between from about 1 mg to about 500 mg of an active ingredient.

It is understood that the specific dose level for any particular subject depends upon a variety of factors including the activity of the specific compound employed, the age, body weight, general health, sex, diet, time of administration, route of administration, and rate of excretion, drug combination and the severity of the particular disease undergoing therapy.

For administration to non-human animals, the composition can also be added to the animal feed or drinking water. It can be convenient to formulate the animal feed and drinking water compositions so that the animal takes in a therapeutically appropriate quantity of the composition along with its diet. It can also be convenient to present the composition as a premix for addition to the feed or drinking water.

The nucleic acid molecules of the present invention can also be administered to a subject in combination with other therapeutic compounds to increase the overall therapeutic effect. The use of multiple compounds to treat an indication can increase the beneficial effects while reducing the presence of side effects.

In one embodiment, the invention comprises compositions suitable for administering nucleic acid molecules of the invention to specific cell types. For example, the asialoglycoprotein receptor (ASGPr) (Wu and Wu, 1987, *J. Biol. Chem.* 262, 4429-4432) is unique to hepatocytes and binds branched galactose-terminal glycoproteins, such as asialoorosomucoid (ASOR). In another example, the folate receptor is overexpressed in many cancer cells. Binding of such glycoproteins, synthetic glycoconjugates, or folates to the receptor takes place with an affinity that strongly depends on the degree of branching of the oligosaccharide chain, for example, triatennary structures are bound with greater affinity than biatenarry or monoatennary chains (Baenziger and Fiete, 1980, *Cell*, 22, 611-620; Connolly et al., 1982, *J. Biol. Chem.*, 257, 939-945). Lee and Lee, 1987, *Glycoconjugate J.*, 4, 317-328, obtained this high specificity through the use of N-acetyl-D-galactosamine as the carbohydrate moiety, which has higher affinity for the receptor, compared to galactose. This "clustering effect" has also been described for the binding and uptake of mannosyl-terminating glycoproteins or glycoconjugates (Ponpipom et al., 1981, *J. Med. Chem.*, 24, 1388-1395). The use of galactose, galactosamine, or folate based conjugates to transport exogenous compounds across cell membranes can provide a targeted delivery approach to, for example, the treatment of liver disease, cancers of the liver, or other cancers. The use of bioconjugates can also provide a reduction in the required dose of therapeutic compounds required for treatment. Furthermore, therapeutic bioavailability, pharmacodynamics, and pharmacokinetic parameters can be modulated through the use of nucleic acid bioconjugates of the invention. Non-limiting examples of such bioconjugates are described in Vargeese et al., U.S. Ser. No. 10/201,394, filed Aug. 13, 2001; and Matulic-Adamic et al., U.S. Ser. No. 60/362,016, filed Mar. 6, 2002.

Alternatively, certain siNA molecules of the instant invention can be expressed within cells from eukaryotic promoters (e.g., Izant and Weintraub, 1985, *Science*, 229, 345; McGarry and Lindquist, 1986, *Proc. Natl. Acad. Sci.*, USA 83, 399; Scanlon et al., 1991, *Proc. Natl. Acad. Sci. USA*, 88, 10591-5; Kashani-Sabet et al., 1992, *Antisense Res. Dev.*, 2, 3-15; Dropulic et al., 1992, *J. Virol.*, 66, 1432-41; Weerasinghe et al., 1991, *J. Virol.*, 65, 5531-4; Ojwang et al., 1992, *Proc. Natl. Acad. Sci. USA*, 89, 10802-6; Chen et al., 1992, *Nucleic Acids Res.*, 20, 4581-9; Sarver et al., 1990 *Science*, 247, 1222-1225; Thompson et al., 1995, *Nucleic Acids Res.*, 23, 2259; Good et al., 1997, *Gene Therapy*, 4, 45. Those skilled in the art realize that any nucleic acid can be expressed in eukaryotic cells from the appropriate DNA/RNA vector. The activity of such nucleic acids can be augmented by their release from the primary transcript by a enzymatic nucleic acid (Draper et al., PCT WO 93/23569, and Sullivan et al., PCT WO 94/02595; Ohkawa et al., 1992, *Nucleic Acids Symp. Ser.*, 27, 15-6; Taira et al., 1991, *Nucleic Acids Res.*, 19, 5125-30; Ventura et al., 1993, *Nucleic Acids Res.*, 21, 3249-55; Chowrira et al., 1994, *J. Biol. Chem.*, 269, 25856.

In another aspect of the invention, RNA molecules of the present invention can be expressed from transcription units (see for example Couture et al., 1996, *TIG.*, 12, 510) inserted into DNA or RNA vectors. The recombinant vectors can be DNA plasmids or viral vectors. siNA expressing viral vectors can be constructed based on, but not limited to, adeno-associated virus, retrovirus, adenovirus, or alphavirus. In another embodiment, pol III based constructs are used to express nucleic acid molecules of the invention (see for example Thompson, U.S. Pat. Nos. 5,902,880 and 6,146,886). The recombinant vectors capable of expressing the siNA molecules can be delivered as described above, and persist in target cells. Alternatively, viral vectors can be used that provide for transient expression of nucleic acid molecules. Such vectors can be repeatedly administered as necessary. Once expressed, the siNA molecule interacts with the target mRNA and generates an RNAi response. Delivery of siNA molecule expressing vectors can be systemic, such as by intravenous or intra-muscular administration, by administration to target cells ex-planted from a subject followed by reintroduction into the subject, or by any other means that would allow for introduction into the desired target cell (for a review see Couture et al., 1996, *TIG.*, 12, 510).

In one aspect the invention features an expression vector comprising a nucleic acid sequence encoding at least one siNA molecule of the instant invention. The expression vector can encode one or both strands of a siNA duplex, or a single self-complementary strand that self hybridizes into a siNA duplex. The nucleic acid sequences encoding the siNA molecules of the instant invention can be operably linked in a manner that allows expression of the siNA molecule (see for example Paul et al., 2002, *Nature Biotechnology*, 19, 505; Miyagishi and Taira, 2002, *Nature Biotechnology*, 19, 497; Lee et al., 2002, *Nature Biotechnology*, 19, 500; and Novina et al., 2002, Nature Medicine, advance online publication doi:10.1038/nm725).

In another aspect, the invention features an expression vector comprising: a) a transcription initiation region (e.g., eukaryotic pol I, II or III initiation region); b) a transcription termination region (e.g., eukaryotic pol I, II or III termination region); and c) a nucleic acid sequence encoding at least one of the siNA molecules of the instant invention, wherein said sequence is operably linked to said initiation region and said termination region in a manner that allows expression and/or delivery of the siNA molecule. The vector can optionally include an open reading frame (ORF) for a protein operably linked on the 5' side or the 3'-side of the sequence encoding the siNA of the invention; and/or an intron (intervening sequences).

Transcription of the siNA molecule sequences can be driven from a promoter for eukaryotic RNA polymerase I (pol I), RNA polymerase II (pol II), or RNA polymerase III (pol III). Transcripts from pol II or pol III promoters are expressed at high levels in all cells; the levels of a given pol II promoter in a given cell type depends on the nature of the gene regulatory sequences (enhancers, silencers, etc.) present nearby. Prokaryotic RNA polymerase promoters are also used, providing that the prokaryotic RNA polymerase enzyme is expressed in the appropriate cells (Elroy-Stein and Moss, 1990, *Proc. Natl. Acad. Sci. USA,* 87, 6743-7; Gao and Huang 1993, *Nucleic Acids Res.,* 21, 2867-72; Lieber et al., 1993, *Methods Enzymol.,* 217, 47-66; Zhou et al., 1990, *Mol. Cell. Biol.,* 10, 4529-37). Several investigators have demonstrated that nucleic acid molecules expressed from such promoters can function in mammalian cells (e.g. Kashani-Sabet et al., 1992, *Antisense Res. Dev.,* 2, 3-15; Ojwang et al., 1992, *Proc. Natl. Acad. Sci. USA,* 89, 10802-6; Chen et al., 1992, *Nucleic Acids Res.,* 20, 4581-9; Yu et al., 1993, *Proc. Natl. Acad. Sci. USA,* 90, 6340-4; L'Huillier et al., 1992, *EMBO J.,* 11, 4411-8; Lisziewicz et al., 1993, *Proc. Natl. Acad. Sci. U.S. A,* 90, 8000-4; Thompson et al., 1995, *Nucleic Acids Res.,* 23, 2259; Sullenger & Cech, 1993, *Science,* 262, 1566). More specifically, transcription units such as the ones derived from genes encoding U6 small nuclear (snRNA), transfer RNA (tRNA) and adenovirus VA RNA are useful in generating high concentrations of desired RNA molecules such as siNA in cells (Thompson et al., supra; Couture and Stinchcomb, 1996, supra; Noonberg et al., 1994, *Nucleic Acid Res.,* 22, 2830; Noonberg et al., U.S. Pat. No. 5,624,803; Good et al., 1997, *Gene Ther.,* 4, 45; Beigelman et al., International PCT Publication No. WO 96/18736. The above siNA transcription units can be incorporated into a variety of vectors for introduction into mammalian cells, including but not restricted to, plasmid DNA vectors, viral DNA vectors (such as adenovirus or adeno-associated virus vectors), or viral RNA vectors (such as retroviral or alphavirus vectors) (for a review see Couture and Stinchcomb, 1996, supra).

In another aspect the invention features an expression vector comprising a nucleic acid sequence encoding at least one of the siNA molecules of the invention in a manner that allows expression of that siNA molecule. The expression vector comprises in one embodiment; a) a transcription initiation region; b) a transcription termination region; and c) a nucleic acid sequence encoding at least one strand of the siNA molecule, wherein the sequence is operably linked to the initiation region and the termination region in a manner that allows expression and/or delivery of the siNA molecule.

In another embodiment the expression vector comprises: a) a transcription initiation region; b) a transcription termination region; c) an open reading frame; and d) a nucleic acid sequence encoding at least one strand of a siNA molecule, wherein the sequence is operably linked to the 3'-end of the open reading frame and wherein the sequence is operably linked to the initiation region, the open reading frame and the termination region in a manner that allows expression and/or delivery of the siNA molecule. In yet another embodiment, the expression vector comprises: a) a transcription initiation region; b) a transcription termination region; c) an intron; and d) a nucleic acid sequence encoding at least one siNA molecule, wherein the sequence is operably linked to the initiation region, the intron and the termination region in a manner which allows expression and/or delivery of the nucleic acid molecule.

In another embodiment, the expression vector comprises: a) a transcription initiation region; b) a transcription termination region; c) an intron; d) an open reading frame; and e) a nucleic acid sequence encoding at least one strand of a siNA molecule, wherein the sequence is operably linked to the 3'-end of the open reading frame and wherein the sequence is operably linked to the initiation region, the intron, the open reading frame and the termination region in a manner which allows expression and/or delivery of the siNA molecule.

HCV Biology and Biochemistry

In 1989, the Hepatitis C Virus (HCV) was determined to be an RNA virus and was identified as the causative agent of most non-A non-B viral Hepatitis (Choo et al., 1989, Science, 244, 359-362). Unlike retroviruses such as HIV, HCV does not go though a DNA replication phase and no integrated forms of the viral genome into the host chromosome have been detected (Houghton et al., 1991, Hepatology, 14, 381-388). Rather, replication of the coding (plus) strand is mediated by the production of a replicative (minus) strand leading to the generation of several copies of plus strand HCV RNA. The genome consists of a single, large, open-reading frame that is translated into a polyprotein (Kato et al., 1991, FEBS Letters, 280: 325-328). This polyprotein subsequently undergoes post-translational cleavage, producing several viral proteins (Leinbach et al., 1994, Virology, 204:163-169).

Examination of the 9.5-kilobase genome of HCV has demonstrated that the viral nucleic acid can mutate at a high rate (Smith et al., 1997 Mol. Evol. 45, 238-246). This rate of mutation has led to the evolution of several distinct genotypes of HCV that share approximately 70% sequence identity (Simmonds et al., 1994, J. Gen. Virol. 75, 1053-1061). It is important to note that these sequences are evolutionarily quite distant. For example, the genetic identity between humans and primates such as the chimpanzee is approximately 98%. In addition, it has been demonstrated that an HCV infection in an individual patient is composed of several distinct and evolving quasispecies that have 98% identity at the RNA level. Thus, the HCV genome is hypervariable and continuously changing. Although the HCV genome is hypervariable, there are 3 regions of the genome that are highly conserved. These conserved sequences occur in the 5' and 3' non-coding regions as well as the 5'-end of the core protein coding region and are thought to be vital for HCV RNA replication as well as translation of the HCV polyprotein. Thus, therapeutic agents that target these conserved HCV genomic regions may have a significant impact over a wide range of HCV genotypes. Moreover, it is unlikely that drug resistance will occur with enzymatic nucleic acids specific to conserved regions of the HCV genome. In contrast, therapeutic modalities that target inhibition of enzymes such as the viral proteases or helicase are likely to result in the selection for drug resistant strains since the RNA for these viral encoded enzymes is located in the hypervariable portion of the HCV genome.

After initial exposure to HCV, a patient experiences a transient rise in liver enzymes, which indicates that inflammatory processes are occurring (Alter et al., IN: Seeff L B, Lewis J H, eds. Current Perspectives in Hepatology. New York: Plenum Medical Book Co; 1989: 83-89). This elevation in liver enzymes occurs at least 4 weeks after the initial exposure and may last for up to two months (Farci et al., 1991, New England Journal of Medicine. 325, 98-104). Prior to the rise in liver enzymes, it is possible to detect HCV RNA in the patient's serum using RT-PCR analysis (Takahashi et al., 1993, American Journal of Gastroenterology. 88, 240-243). This stage of the disease is called the acute stage and usually goes undetected since 75% of patients with acute viral hepatitis from HCV infection are asymptomatic. The remaining 25% of these patients develop jaundice or other symptoms of hepatitis.

Although acute HCV infection is a benign disease, as many as 80% of acute HCV patients progress to chronic liver disease as evidenced by persistent elevation of serum alanine aminotransferase (ALT) levels and by continual presence of circulating HCV RNA (Sherlock, 1992, Lancet, 339, 802). The natural progression of chronic HCV infection over a 10 to 20 year period leads to cirrhosis in 20 to 50% of patients (Davis et al., 1993, Infectious Agents and Disease, 2, 150, 154) and progression of HCV infection to hepatocellular carcinoma has been well documented (Liang et al., 1993, Hepatology. 18, 1326-1333; Tong et al., 1994, *Western Journal of Medicine*, 160, 133-138). There have been no studies that have determined sub-populations that are most likely to progress to cirrhosis and/or hepatocellular carcinoma, thus all patients have equal risk of progression.

It is important to note that the survival for patients diagnosed with hepatocellular carcinoma is only 0.9 to 12.8 months from initial diagnosis (Takahashi et al., 1993, American Journal of Gastroenterology. 88, 240-243). Treatment of hepatocellular carcinoma with chemotherapeutic agents has not proven effective and only 10% of patients will benefit from surgery due to extensive tumor invasion of the liver (Trinchet et al., 1994, Presse Medicine. 23, 831-833). Given the aggressive nature of primary hepatocellular carcinoma, the only viable treatment alternative to surgery is liver transplantation (Pichlmayr et al., 1994, Hepatology. 20, 33S-40S).

Upon progression to cirrhosis, patients with chronic HCV infection present with clinical features, which are common to clinical cirrhosis regardless of the initial cause (D'Amico et al., 1986, Digestive Diseases and Sciences. 31, 468-475). These clinical features may include: bleeding esophageal varices, ascites, jaundice, and encephalopathy (Zakim D, Boyer T D. Hepatology a textbook of liver disease. Second Edition Volume 1. 1990 W.B. Saunders Company. Philadelphia). In the early stages of cirrhosis, patients are classified as compensated, the stage at which the patient's liver is still able to detoxify metabolites in the blood-stream although liver tissue damage has occurred. In addition, most patients with compensated liver disease are asymptomatic and the minority with symptoms report only minor symptoms, such as dyspepsia and weakness. In the later stages of cirrhosis, patients are classified as decompensated, the stage at which the ability of the liver to detoxify metabolites in the bloodstream is diminished. It is at the decompensated stage that the clinical features described above present.

In 1986, D'Amico et al. described the clinical manifestations and survival rates in 1155 patients with both alcoholic and viral associated cirrhosis (D'Amico supra). Of the 1155 patients, 435 (37%) had compensated disease although 70% were asymptomatic at the beginning of the study. The remaining 720 patients (63%) had decompensated liver disease with 78% presenting with a history of ascites, 31% with jaundice, 17% had bleeding and 16% had encephalopathy. Hepatocellular carcinoma was observed in six (0.5%) patients with compensated disease and in 30 (2.6%) patients with decompensated disease.

Over the course of six years, the patients with compensated cirrhosis developed clinical features of decompensated disease at a rate of 10% per year. In most cases, ascites was the first presentation of decompensation. In addition, hepatocellular carcinoma developed in 59 patients who initially presented with compensated disease by the end of the six-year study.

With respect to survival, the D'Amico study indicated that the five-year survival rate for all patients in the study was only 40%. The six-year survival rate for the patients who initially had compensated cirrhosis was 54% while the six-year survival rate for patients who initially presented with decompensated disease was only 21%. There were no significant differences in the survival rates between the patients who had alcoholic cirrhosis and the patients with viral related cirrhosis. The major causes of death for the patients in the D'Amico study were liver failure in 49%; hepatocellular carcinoma in 22%; and bleeding in 13% (D'Amico supra).

Chronic Hepatitis C is a slowly progressing inflammatory disease of the liver, mediated by a virus (HCV) that can lead to cirrhosis, liver failure and/or hepatocellular carcinoma over a period of 10 to 20 years. In the US, it is estimated that infection with HCV accounts for 50,000 new cases of acute hepatitis in the United States each year (NIH Consensus Development Conference Statement on Management of Hepatitis C March 1997). The prevalence of HCV in the United States is estimated at 1.8% and the CDC places the number of chronically infected Americans at approximately 4.5 million people. The CDC also estimates that up to 10,000 deaths per year are caused by chronic HCV infection.

Numerous well controlled clinical trials using interferon (IFN-alpha) in the treatment of chronic HCV infection have demonstrated that treatment three times a week results in lowering of serum ALT values in approximately 50% (40%-70%) of patients by the end of 6 months of therapy (Davis et al., 1989, New England Journal of Medicine, 321, 1501-1506; Marcellin et al., 1991, Hepatology, 13, 393-397; Tong et al., 1997, Hepatology, 26, 747-754; Tong et al., 1997, Hepatology, 26, 1640-1645). However, following cessation of interferon treatment, approximately 50% of the responding patients relapsed, resulting in a "durable" response rate as assessed by normalization of serum ALT concentrations of approximately 20-25%.

Direct measurement of HCV RNA is possible through use of either the branched-DNA or Reverse Transcriptase Polymerase Chain Reaction (RT-PCR) analysis. In general, RT-PCR methodology is more sensitive and leads to a more accurate assessment of the clinical course (Tong et al., supra). Studies that have examined six months of type 1 interferon therapy using changes in HCV RNA values as a clinical endpoint have demonstrated that up to 35% of patients have a loss of HCV RNA by the end of therapy (Marcellin et al., supra). However, as with the ALT endpoint, about 50% of the patients relapse within six months following cessation of therapy, resulting in a durable virologic response of only 12% (Marcellin et al., supra). Studies that have examined 48 weeks of therapy have demonstrated that the sustained virological response is up to 25% (NIH consensus statement: 1997). Thus, standard of care for treatment of chronic HCV infection with type 1 interferon is now 48 weeks of therapy using changes in HCV RNA concentrations as the primary assessment of efficacy (Hoofnagle et al., 1997, *New England Journal of Medicine*, 336, 347-356).

Side effects resulting from treatment with type 1 interferons can be divided into four general categories, which include: (1) Influenza-like symptoms; (2) Neuropsychiatric; (3) Laboratory abnormalities; and (4) Miscellaneous (Dusheiko et al., 1994, *Journal of Viral Hepatitis*, 1, 3-5). Examples of influenza-like symptoms include fatigue, fever, myalgia, malaise, appetite loss, tachycardia, rigors, headache, and arthralgias. The influenza-like symptoms are usually short-lived and tend to abate after the first four weeks of dosing (Dushieko et al., supra). Neuropsychiatric side effects include irritability, apathy, mood changes, insomnia, cognitive changes, and depression. The most important of these neuropsychiatric side effects is depression and patients who have a history of depression should not be given type 1 interferon. Laboratory abnormalities include reduction in myeloid cells, including granulocytes, platelets and to a lesser extent red blood cells. These changes in blood cell counts rarely lead to any significant clinical sequellae (Dushieko et al., supra). In addition, increases in triglyceride concentrations and elevations in serum alanine and aspartate aminotransferase concentration have been observed. Finally, thyroid abnormalities have been reported. These thyroid abnormalities are usually reversible after cessation of interferon therapy and can be controlled with appropriate medication while on therapy. Miscellaneous side effects include nausea, diarrhea, abdominal and back pain, pruritus, alopecia, and rhinorrhea. In general, most side effects will abate after 4 to 8 weeks of therapy (Dushieko et al., supra).

The use of small interfering nucleic acid molecules targeting HCV genes and cellular/host gene targets associated with the HIV life cycle therefore provides a class of novel therapeutic agents that can be used in the treatment and diagnosis of HCV infection, liver failure, hepatocellular carcinoma, cirrhosis or any other disease or condition that responds to modulation (e.g., inhibition) of HCV genes in a subject or organism.

EXAMPLES

The following are non-limiting examples showing the selection, isolation, synthesis and activity of nucleic acids of the instant invention.

Example 1

Tandem Synthesis of siNA Constructs

Exemplary siNA molecules of the invention are synthesized in tandem using a cleavable linker, for example, a succinyl-based linker. Tandem synthesis as described herein is followed by a one-step purification process that provides RNAi molecules in high yield. This approach is highly amenable to siNA synthesis in support of high throughput RNAi screening, and can be readily adapted to multi-column or multi-well synthesis platforms.

After completing a tandem synthesis of a siNA oligo and its complement in which the 5'-terminal dimethoxytrityl (5'-O-DMT) group remains intact (trityl on synthesis), the oligonucleotides are deprotected as described above. Following deprotection, the siNA sequence strands are allowed to spontaneously hybridize. This hybridization yields a duplex in which one strand has retained the 5'-O-DMT group while the complementary strand comprises a terminal 5'-hydroxyl. The newly formed duplex behaves as a single molecule during routine solid-phase extraction purification (Trityl-On purification) even though only one molecule has a dimethoxytrityl group. Because the strands form a stable duplex, this dimethoxytrityl group (or an equivalent group, such as other trityl groups or other hydrophobic moieties) is all that is required to purify the pair of oligos, for example, by using a C18 cartridge.

Standard phosphoramidite synthesis chemistry is used up to the point of introducing a tandem linker, such as an inverted deoxy abasic succinate or glyceryl succinate linker (see FIG. 1) or an equivalent cleavable linker. A non-limiting example of linker coupling conditions that can be used includes a hindered base such as diisopropylethylamine (DIPA) and/or DMAP in the presence of an activator reagent such as Bromotripyrrolidinophosphoniumhexafluororophosphate (Py-BrOP). After the linker is coupled, standard synthesis chemistry is utilized to complete synthesis of the second sequence leaving the terminal the 5'-O-DMT intact. Following synthesis, the resulting oligonucleotide is deprotected according to the procedures described herein and quenched with a suitable buffer, for example with 50 mM NaOAc or 1.5M $NH_4H_2CO_3$.

Purification of the siNA duplex can be readily accomplished using solid phase extraction, for example, using a Waters C18 SepPak 1 g cartridge conditioned with 1 column volume (CV) of acetonitrile, 2 CV $H_2O$, and 2 CV 50 mM NaOAc. The sample is loaded and then washed with 1 CV $H_2O$ or 50 mM NaOAc. Failure sequences are eluted with 1 CV 14% ACN (Aqueous with 50 mM NaOAc and 50 mM NaCl). The column is then washed, for example with 1 CV $H_2O$ followed by on-column detritylation, for example by passing 1 CV of 1% aqueous trifluoroacetic acid (TFA) over the column, then adding a second CV of 1% aqueous TFA to the column and allowing to stand for approximately 10 minutes. The remaining TFA solution is removed and the column washed with H20 followed by 1 CV 1M NaCl and additional $H_2O$. The siNA duplex product is then eluted, for example, using 1 CV 20% aqueous CAN.

Figure 2:
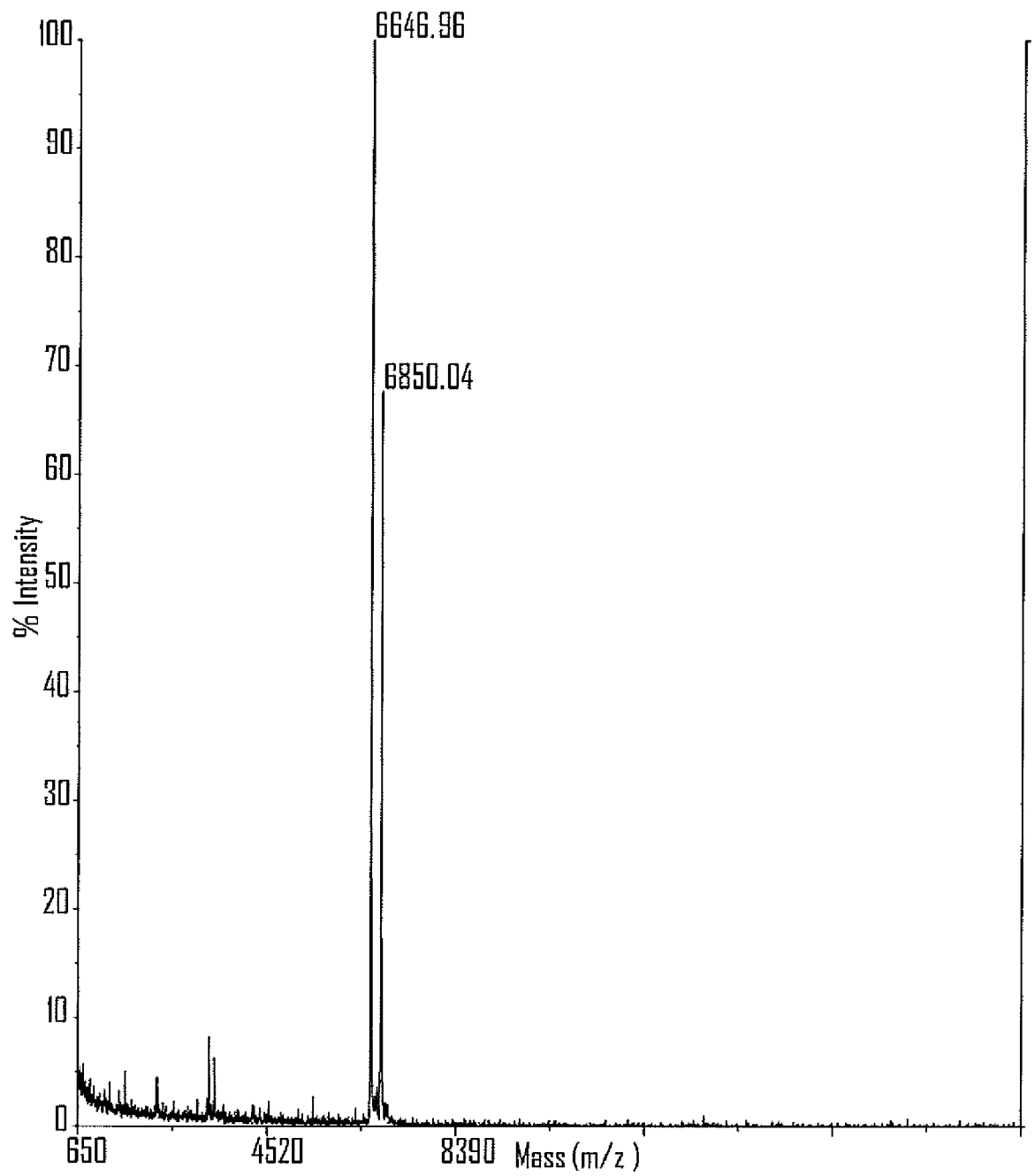
FIG. 2 shows a MALDI-TOF mass spectrum of a purified siNA duplex synthesized by a method of the invention. The two peaks shown correspond to the predicted mass of the separate siNA sequence strands. This result demonstrates that the siNA duplex generated from tandem synthesis can be purified as a single entity using a simple trityl-on purification methodology.
Figure 3:
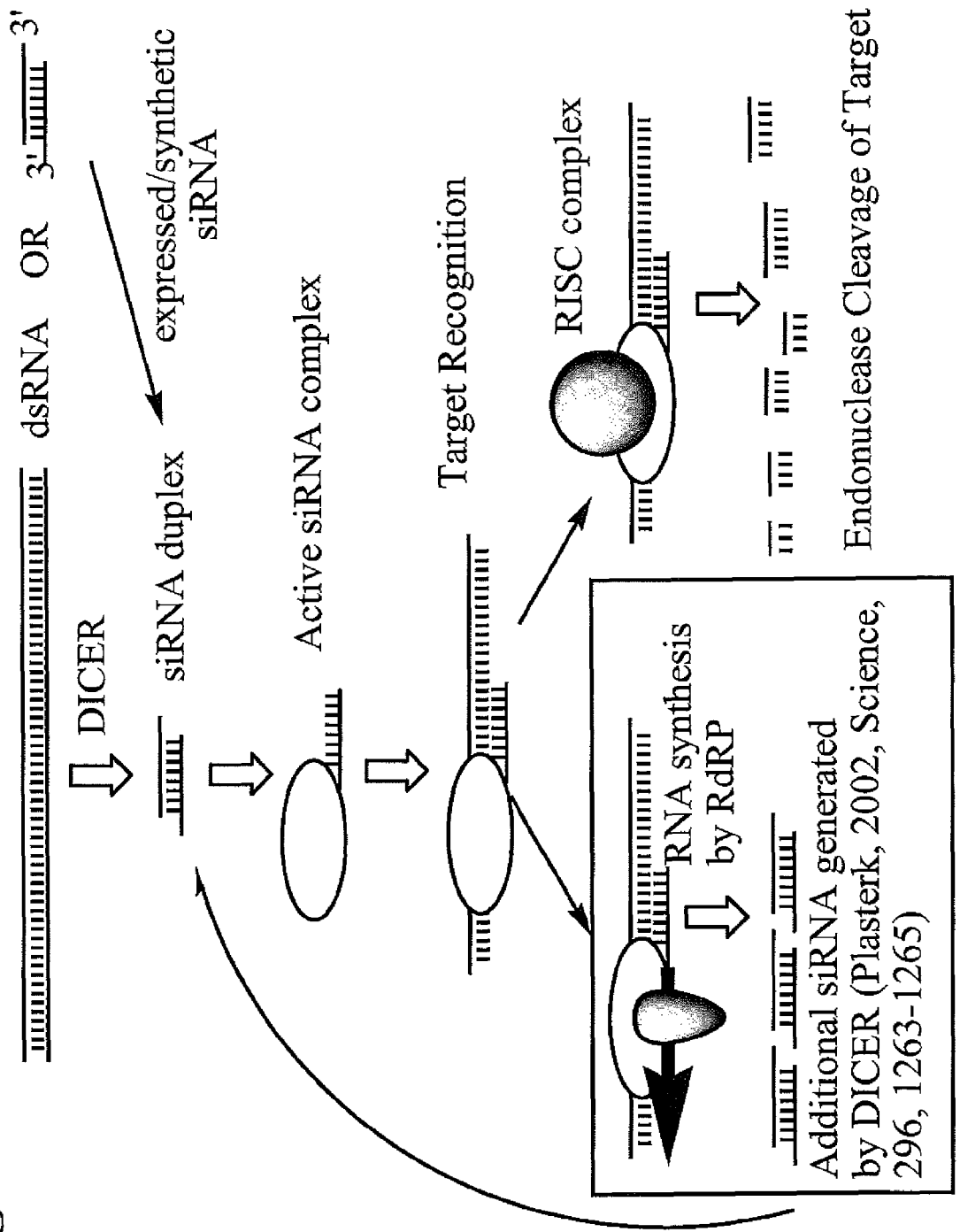
FIG. 3 shows a non-limiting proposed mechanistic representation of target RNA degradation involved in RNAi. Double-stranded RNA (dsRNA), which is generated by RNA-dependent RNA polymerase (RdRP) from foreign single-stranded RNA, for example viral, transposon, or other exogenous RNA, activates the DICER enzyme that in turn generates siNA duplexes. Alternately, synthetic or expressed siNA can be introduced directly into a cell by appropriate means. An active siNA complex forms which recognizes a target RNA, resulting in degradation of the target RNA by the RISC endonuclease complex or in the synthesis of additional RNA by RNA-dependent RNA polymerase (RdRP), which can activate DICER and result in additional siNA molecules, thereby amplifying the RNAi response.

FIG. 2 provides an example of MALDI-TOF mass spectrometry analysis of a purified siNA construct in which each peak corresponds to the calculated mass of an individual siNA strand of the siNA duplex. The same purified siNA provides three peaks when analyzed by capillary gel electrophoresis (CGE), one peak presumably corresponding to the duplex siNA, and two peaks presumably corresponding to the separate siNA sequence strands. Ion exchange HPLC analysis of the same siNA contract only shows a single peak. Testing of the purified siNA construct using a luciferase reporter assay described below demonstrated the same RNAi activity compared to siNA constructs generated from separately synthesized oligonucleotide sequence strands.

Example 2

Identification of Potential siNA Target Sites in any RNA Sequence

The sequence of an RNA target of interest, such as a viral or human mRNA transcript (e.g., any of sequences referred to herein by GenBank Accession Number), is screened for target sites, for example by using a computer folding algorithm. In a non-limiting example, the sequence of a gene or RNA gene transcript derived from a database, such as Genbank, is used to generate siNA targets having complementarity to the target. Such sequences can be obtained from a database, or can be determined experimentally as known in the art. Target sites that are known, for example, those target sites determined to be effective target sites based on studies with other nucleic acid molecules, for example ribozymes or antisense, or those targets known to be associated with a disease, trait, or condition such as those sites containing mutations or deletions, can be used to design siNA molecules targeting those sites. Various parameters can be used to determine which sites are the most suitable target sites within the target RNA sequence. These parameters include but are not limited to secondary or tertiary RNA structure, the nucleotide base composition of the target sequence, the degree of homology between various regions of the target sequence, or the relative position of the target sequence within the RNA transcript. Based on these determinations, any number of target sites within the RNA transcript can be chosen to screen siNA molecules for efficacy, for example by using in vitro RNA cleavage assays, cell culture, or animal models. In a non-limiting example, anywhere from 1 to 1000 target sites are chosen within the transcript based on the size of the siNA construct to be used. High throughput screening assays can be developed for screening siNA molecules using methods known in the art, such as with multi-well or multi-plate assays to determine efficient reduction in target gene expression.

Example 3

Selection of siNA Molecule Target Sites in a RNA

The following non-limiting steps can be used to carry out the selection of siNAs targeting a given gene sequence or transcript.

1. The target sequence is parsed in silico into a list of all fragments or subsequences of a particular length, for example 23 nucleotide fragments, contained within the target sequence. This step is typically carried out using a custom Perl script, but commercial sequence analysis programs such as Oligo, MacVector, or the GCG Wisconsin Package can be employed as well.

2. In some instances the siNAs correspond to more than one target sequence; such would be the case for example in targeting different transcripts of the same gene, targeting different transcripts of more than one gene, or for targeting both the human gene and an animal homolog. In this case, a subsequence list of a particular length is generated for each of the targets, and then the lists are compared to find matching sequences in each list. The subsequences are then ranked according to the number of target sequences that contain the given subsequence; the goal is to find subsequences that are present in most or all of the target sequences. Alternately, the ranking can identify subsequences that are unique to a target sequence, such as a mutant target sequence. Such an approach would enable the use of siNA to target specifically the mutant sequence and not effect the expression of the normal sequence.

3. In some instances the siNA subsequences are absent in one or more sequences while present in the desired target sequence; such would be the case if the siNA targets a gene with a paralogous family member that is to remain untargeted. As in case 2 above, a subsequence list of a particular length is generated for each of the targets, and then the lists are compared to find sequences that are present in the target gene but are absent in the untargeted paralog.

4. The ranked siNA subsequences can be further analyzed and ranked according to GC content. A preference can be given to sites containing 30-70% GC, with a further preference to sites containing 40-60% GC.

5. The ranked siNA subsequences can be further analyzed and ranked according to self-folding and internal hairpins. Weaker internal folds are preferred; strong hairpin structures are to be avoided.

6. The ranked siNA subsequences can be further analyzed and ranked according to whether they have runs of GGG or CCC in the sequence. GGG (or even more Gs) in either strand can make oligonucleotide synthesis problematic and can potentially interfere with RNAi activity, so it is avoided whenever better sequences are available. CCC is searched in the target strand because that will place GGG in the antisense strand.

7. The ranked siNA subsequences can be further analyzed and ranked according to whether they have the dinucleotide UU (uridine dinucleotide) on the 3'-end of the sequence, and/or AA on the 5'-end of the sequence (to yield 3' UU on the antisense sequence). These sequences allow one to design siNA molecules with terminal TT thymidine dinucleotides.

8. Four or five target sites are chosen from the ranked list of subsequences as described above. For example, in subsequences having 23 nucleotides, the right 21 nucleotides of each chosen 23-mer subsequence are then designed and synthesized for the upper (sense) strand of the siNA duplex, while the reverse complement of the left 21 nucleotides of each chosen 23-mer subsequence are then designed and synthesized for the lower (antisense) strand of the siNA duplex (see Table II). If terminal TT residues are desired for the sequence (as described in paragraph 7), then the two 3' terminal nucleotides of both the sense and antisense strands are replaced by TT prior to synthesizing the oligos.

9. The siNA molecules are screened in an in vitro, cell culture or animal model system to identify the most active siNA molecule or the most preferred target site within the target RNA sequence.

10. Other design considerations can be used when selecting target nucleic acid sequences, see, for example, Reynolds et al., 2004, *Nature Biotechnology Advanced Online Publication*, 1 Feb. 2004, doi:10.1038/nbt936 and Ui-Tei et al., 2004, Nucleic Acids Research, 32, doi: 10.1093/nar/gkh247.

Figure 9:
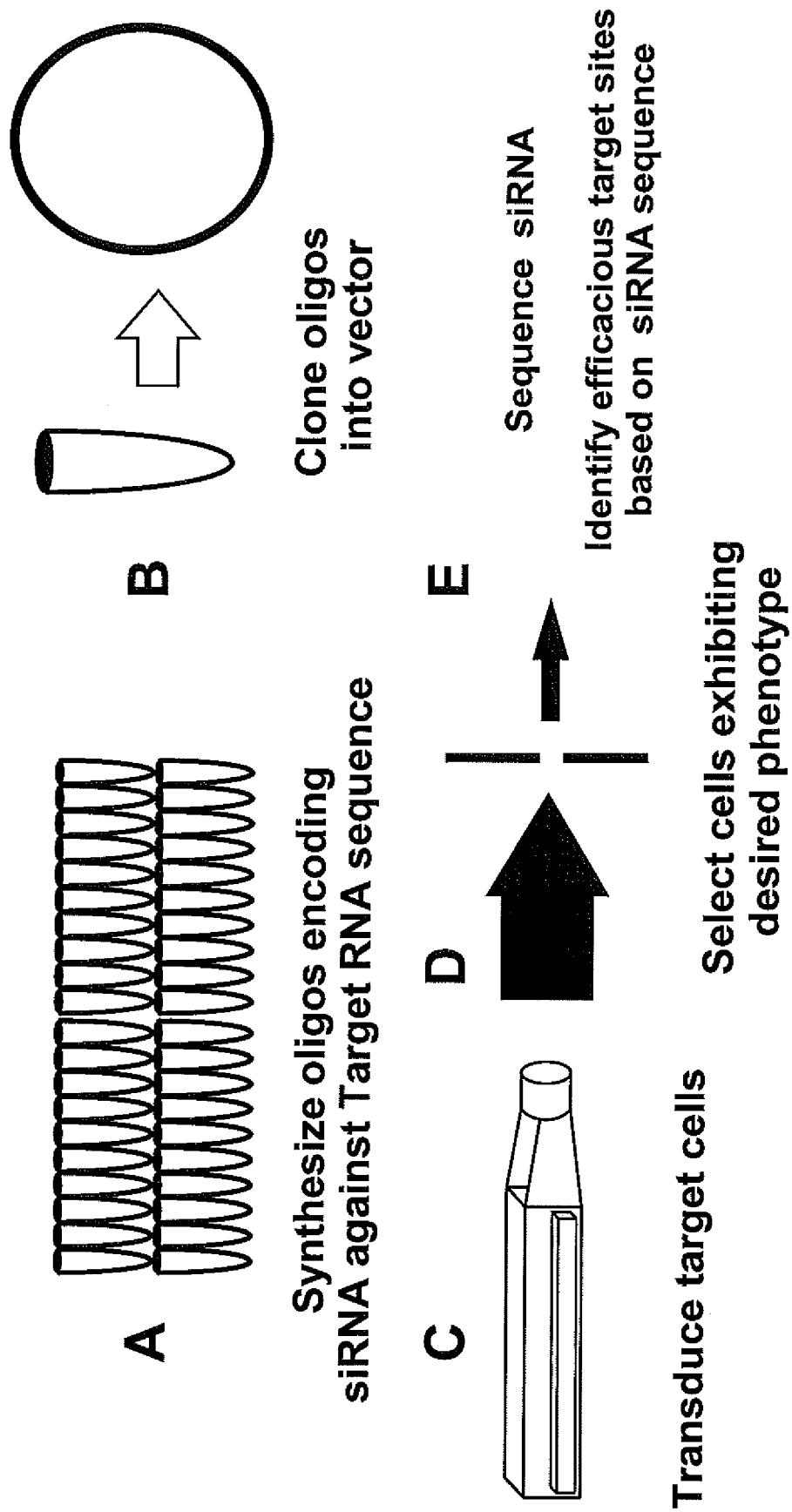

In an alternate approach, a pool of siNA constructs specific to a target sequence is used to screen for target sites in cells expressing target RNA, such as cultured Jurkat, HeLa, A549 or 293T cells. The general strategy used in this approach is shown in FIG. 9. Cells expressing the target RNA are transfected with the pool of siNA constructs and cells that demonstrate a phenotype associated with target inhibition are sorted. The pool of siNA constructs can be expressed from transcription cassettes inserted into appropriate vectors (see for example FIG. 7 and FIG. 8). The siNA from cells demonstrating a positive phenotypic change (e.g., decreased proliferation, decreased target mRNA levels or decreased target protein expression), are sequenced to determine the most suitable target site(s) within the target RNA sequence.

In one embodiment, siNA molecules of the invention are selected using the following methodology. The following guidelines were compiled to predict hyper-active siNAs that contain chemical modifications described herein. These rules emerged from a comparative analysis of hyper-active (>75% knockdown of target mRNA levels) and inactive (<75% knockdown of target mRNA levels) siNAs against several different targets. A total of 242 siNA sequences were analyzed. Thirty-five siNAs out of 242 siNAs were grouped into hyper-active and the remaining siNAs were grouped into inactive groups. The hyper-active siNAs clearly showed a preference for certain bases at particular nucleotide positions within the siNA sequence. For example, A or U nucleobase was overwhelmingly present at position 19 of the sense strand in hyper-active siNAs and opposite was true for inactive siNAs. There was also a pattern of a A/U rich (3 out of 5 bases as A or U) region between positions 15-19 and G/C rich region between positions 1-5 (3 out of 5 bases as G or C) of the sense strand in hyperactive siNAs. As shown in Table VII, 12 such patterns were identified that were characteristics of hyper-active siNAs. It is to be noted that not every pattern was present in each hyper-active siNA. Thus, to design an algorithm for predicting hyper-active siNAs, a different score was assigned for each pattern. Depending on how frequently such patterns occur in hyper-active siNAs versus inactive siNAs, the design parameters were assigned a score with the highest being 10. If a certain nucleobase is not preferred at a position, then a negative score was assigned. For example, at positions 9 and 13 of the sense strand, a G nucleotide was not preferred in hyper-active siNAs and therefore they were given score of −3(minus 3). The differential score for each pattern is given in Table VII. The pattern # 4 was given a maximum score of −100. This is mainly to weed out any sequence that contains string of 4Gs or 4Cs as they can be highly incompatible for synthesis and can allow sequences to self-aggregate, thus rendering the siNA inactive. Using this algorithm, the highest score possible for any siNA is 66. As there are numerous siNA sequences possible against any given target of reasonable size (~1000 nucleotides), this algorithm is useful to generate hyper-active siNAs.

In one embodiment, rules 1-11 shown in Table VII are used to generate active siNA molecules of the invention. In another embodiment, rules 1-12 shown in Table VII are used to generate active siNA molecules of the invention.

Example 4 siNA Design siNA target sites were chosen by analyzing sequences of the target and optionally prioritizing the target sites on the basis of the rules presented in Example 3 above, and alternately on the basis of folding (structure of any given sequence analyzed to determine siNA accessibility to the target), or by using a library of siNA molecules as described in Example 3, or alternately by using an in vitro siNA system as described in Example 6 herein. siNA molecules were designed that could bind each target and are selected using the algorithm above and are optionally individually analyzed by computer folding to assess whether the siNA molecule can interact with the target sequence. Varying the length of the siNA molecules can be chosen to optimize activity. Generally, a sufficient number of complementary nucleotide bases are chosen to bind to, or otherwise interact with, the target RNA, but the degree of complementarity can be modulated to accommodate siNA duplexes or varying length or base composition. By using such methodologies, siNA molecules can be designed to target sites within any known RNA sequence, for example those RNA sequences corresponding to the any gene transcript.

Target sequences are analysed to generate targets from which double stranded siNA are designed (Table II). To generate synthetic siNA constructs, the algorithm described in Example 3 is utilized to pick active double stranded constructs and chemically modified versions thereof. For example, in Table II, the target sequence is shown, along with the upper (sense strand) and lower (antisense strand) of the siNA duplex. Multifunctional siNAs are designed by searching for homologous sites between different target sequences (e.g., from about 5 to about 15 nucleotide regions of shared homology) and allowing for non-canonical base pairs (e.g. G:U wobble base pairing) or mismatched base pairs.

Chemically modified siNA constructs were designed as described herein (see for example Table III) to provide nuclease stability for systemic administration in vivo and/or improved pharmacokinetic, localization, and delivery properties while preserving the ability to mediate RNAi activity. Chemical modifications as described herein are introduced synthetically using synthetic methods described herein and those generally known in the art. The synthetic siNA constructs are then assayed for nuclease stability in serum and/or cellular/tissue extracts (e.g. liver extracts). The synthetic siNA constructs are also tested in parallel for RNAi activity using an appropriate assay, such as a luciferase reporter assay as described herein or another suitable assay that can quantity RNAi activity. Synthetic siNA constructs that possess both nuclease stability and RNAi activity can be further modified and re-evaluated in stability and activity assays. The chemical modifications of the stabilized active siNA constructs can then be applied to any siNA sequence targeting any chosen RNA and used, for example, in target screening assays to pick lead siNA compounds for therapeutic development (see for example FIG. 11).

Example 5

Chemical Synthesis, Purification, and Analysis of siNA siNA molecules can be designed to interact with various sites in the RNA message, for example, target sequences within the RNA sequences described herein. The sequence of one strand of the siNA molecule(s) is complementary to the target site sequences described above. The siNA molecules can be chemically synthesized using methods described herein. Inactive siNA molecules that are used as control sequences can be synthesized by scrambling the sequence of the siNA molecules such that it is not complementary to the target sequence. Generally, siNA constructs can by synthesized using solid phase oligonucleotide synthesis methods as described herein (see for example Usman et al., U.S. Pat. Nos. 5,804,683; 5,831,071; 5,998,203; 6,117,657; 6,353,098; 6,362,323; 6,437,117; 6,469,158; Scaringe et al., U.S. Pat. Nos. 6,111,086; 6,008,400; 6,111,086 all incorporated by reference herein in their entirety).

In a non-limiting example, RNA oligonucleotides are synthesized in a stepwise fashion using the phosphoramidite chemistry as is known in the art. Standard phosphoramidite chemistry involves the use of nucleosides comprising any of 5'-O-dimethoxytrityl, 2'-O-tert-butyldimethylsilyl, 3'-O-2-Cyanoethyl N,N-diisopropylphos-phoroamidite groups, and exocyclic amine protecting groups (e.g. N6-benzoyl adenosine, N4 acetyl cytidine, and N2-isobutyryl guanosine). Alternately, 2'-O-Silyl Ethers can be used in conjunction with acid-labile 2'-O-orthoester protecting groups in the synthesis of RNA as described by Scaringe supra. Differing 2' chemistries can require different protecting groups, for example 2'-deoxy-2'-amino nucleosides can utilize N-phthaloyl protection as described by Usman et al., U.S. Pat. No. 5,631,360, incorporated by reference herein in its entirety).

During solid phase synthesis, each nucleotide is added sequentially (3'- to 5'-direction) to the solid support-bound oligonucleotide. The first nucleoside at the 3'-end of the chain is covalently attached to a solid support (e.g., controlled pore glass or polystyrene) using various linkers. The nucleotide precursor, a ribonucleoside phosphoramidite, and activator are combined resulting in the coupling of the second nucleoside phosphoramidite onto the 5'-end of the first nucleoside. The support is then washed and any unreacted 5'-hydroxyl groups are capped with a capping reagent such as acetic anhydride to yield inactive 5'-acetyl moieties. The trivalent phosphorus linkage is then oxidized to a more stable phosphate linkage. At the end of the nucleotide addition cycle, the 5'-O-protecting group is cleaved under suitable conditions (e.g., acidic conditions for trityl-based groups and fluoride for silyl-based groups). The cycle is repeated for each subsequent nucleotide.

Modification of synthesis conditions can be used to optimize coupling efficiency, for example by using differing coupling times, differing reagent/phosphoramidite concentrations, differing contact times, differing solid supports and solid support linker chemistries depending on the particular chemical composition of the siNA to be synthesized. Deprotection and purification of the siNA can be performed as is generally described in Usman et al., U.S. Pat. Nos. 5,831,071, 6,353,098, 6,437,117, and Bellon et al., U.S. Pat. Nos. 6,054,576, 6,162,909, 6,303,773, or Scaringe supra, incorporated by reference herein in their entireties. Additionally, deprotection conditions can be modified to provide the best possible yield and purity of siNA constructs. For example, applicant has observed that oligonucleotides comprising 2'-deoxy-2'-fluoro nucleotides can degrade under inappropriate deprotection conditions. Such oligonucleotides are deprotected using aqueous methylamine at about 35° C. for 30 minutes. If the 2'-deoxy-2'-fluoro containing oligonucleotide also comprises ribonucleotides, after deprotection with aqueous methylamine at about 35° C. for 30 minutes, TEA-HF is added and the reaction maintained at about 65° C. for an additional 15 minutes. The deprotected single strands of siNA are purified by anion exchange to achieve a high purity while maintaining high yields. To form the siNA duplex molecule the single strands are combined in equal molar ratios in a saline solution to form the duplex. The duplex siNA is concentrated and desalted by tangential filtration prior to lyophilization.

Manufacture of siNA Compositions

In a non-limiting example, for each siNA composition, the two individual, complementary strands of the siNA are synthesized separately using solid phase synthesis, then purified separately by ion exchange chromatography. The complementary strands are annealed to form the double strand (duplex). The duplex is then ultrafiltered and lyophilized to form the solid siNA composition (e.g., pharmaceutical composition). A non-limiting example of the manufacturing process is shown in the flow diagram in Table VIII.

Solid Phase Synthesis

The single strand oligonucleotides are synthesized using phosphoramidite chemistry on an automated solid-phase synthesizer, such as an Amersham Pharmacia AKTA Oligopilot (e.g., Oligopilot or Oligopilot 100 plus). An adjustable synthesis column is packed with solid support derivatized with the first nucleoside residue. Synthesis is initiated by detritylation of the acid labile 5'-O-dimethoxytrityl group to release the 5'-hydroxyl. Phosphoramidite and a suitable activator in acetonitrile are delivered simultaneously to the synthesis column resulting in coupling of the amidite to the 5'-hydroxyl. The column is then washed with acetonitrile. Iodine is pumped through the column to oxidize the phosphite triester linkage P(III) to its phosphotriester P(V) analog. Unreacted 5'-hydroxyl groups are capped using reagents such as acetic anhydride in the presence of 2,6-lutidine and N-methylimidazole. The elongation cycle resumes with the detritylation step for the next phosphoramidite incorporation. This process is repeated until the desired sequence has been synthesized. The synthesis concludes with the removal of the terminal dimethoxytrityl group.

Cleavage and Deprotection

On completion of the synthesis, the solid-support and associated oligonucleotide are transferred to a filter funnel, dried under vacuum, and transferred to a reaction vessel. Aqueous base is added and the mixture is heated to effect cleavage of the succinyl linkage, removal of the cyanoethyl phosphate protecting group, and deprotection of the exocyclic amine protection.

The following process is performed on single strands that do not contain ribonucleotides: After treating the solid support with the aqueous base, the mixture is filtered under vacuum to separate the solid support from the deprotected crude synthesis material. The solid support is then rinsed with water which is combined with the filtrate. The resultant basic solution is neutralized with acid to provide a solution of the crude single strand.

The following process is performed on single strands that contain ribonucleotides: After treating the solid support with the aqueous base, the mixture is filtered under vacuum to separate the solid support from the deprotected crude synthesis material. The solid support is then rinsed with dimethylsulfoxide (DMSO) which is combined with the filtrate. The mixture is cooled, fluoride reagent such as triethylamine trihydrofluoride is added, and the solution is heated. The reaction is quenched with suitable buffer to provide a solution of crude single strand.

Anion Exchange Purification

The solution of each crude single strand is purified using chromatographic purification. The product is eluted using a suitable buffer gradient. Fractions are collected in closed sanitized containers, analyzed by HPLC, and the appropriate fractions are combined to provide a pool of product which is analyzed for purity (HPLC), identity (HPLC), and concentration (UV A260).

Annealing

Based on the analysis of the pools of product, equal molar amounts (calculated using the theoretical extinction coefficient) of the sense and antisense oligonucleotide strands are transferred to a reaction vessel. The solution is mixed and analyzed for purity of duplex by chromatographic methods. If the analysis indicates an excess of either strand, then additional non-excess strand is titrated until duplexing is complete. When analysis indicates that the target product purity has been achieved, the material is transferred to the tangential flow filtration (TFF) system for concentration and desalting.

Ultrafiltration

The annealed product solution is concentrated using a TFF system containing an appropriate molecular weight cut-off membrane. Following concentration, the product solution is desalted via diafiltration using WFI quality water until the conductivity of the filtrate is that of water.

Lyophilization

The concentrated solution is transferred to sanitized trays in a shelf lyophilizer. The product is then freeze-dried to a powder. The trays are removed from the lyophilizer and transferred to a class 100 Laminar Air Flow (LAF) hood for packaging.

Packaging Drug Substance

The lyophilizer trays containing the freeze-dried product are opened in a class 100 LAF hood. The product is transferred to sanitized containers of appropriate size, which are then sealed and labeled.

Drug Substance Container Closure System

Lyophilized drug substance is bulk packaged in sanitized Nalgene containers with sanitized caps. The bottle size used is dependent upon the quantity of material to be placed within it. After filling, each bottle is additionally sealed at the closure with polyethylene tape.

Analytical Methods and Specifications

Raw Material and In-Process Methods

Raw materials are tested for identity prior to introduction into the drug substance manufacturing process. Critical raw materials, those incorporated into the drug substance molecule, are tested additionally using a purity test or an assay test as appropriate. In-process samples are tested at key control points in the manufacturing process to monitor and assure the quality of the final drug substance.

Drug Substance Analytical Methods and Specifications

Controls incorporating analytical methods and acceptance criteria for oligonucleotides are established prior to clinical testing of bulk siNA compositions. The following test methods and acceptance criteria reflect examples of these controls. Table IX summarizes examples of material specifications for siNA pharmaceutical compositions.

Summary of Analytical Methods
Identification (ID) Tests

ID Oligonucleotide Main Peak: The identity of the drug substance is established using a chromatographic method. The data used for this determination is generated by one of the HPLC test methods (see Purity Tests). The peak retention times of the drug substance sample and the standard injections are compared. Drug substance identity is supported by a favorable comparison of the main peak retention times.

Molecular Weight: The identity of the drug substance is established using a spectroscopic method. A sample of drug substance is prepared for analysis by precipitation with aqueous ammonium acetate. The molecular weight of the drug substance is determined by mass spectrometry. The test is controlled to within a set number of atomic mass units from the theoretical molecular weight.

Melting Temperature: This method supports the identity of the drug substance by measurement of the melting temperature (Tm) of the double stranded drug substance. A sample in solution is heated while monitoring the ultraviolet (UV) absorbance of the solution. The Tm is marked by the inflection point of the absorbance curve as the absorbance increases due to the dissociation of the duplex into single strands.

Assay Tests

Oligonucleotide Content: This assay determines the total oligonucleotide content in the drug substance. The oligonucleotide absorbs UV light with a local maximum at 260 nm. The oligonucleotide species present consist of the double stranded siRNA product and other minor related oligonucleotide substances from the manufacturing process, including residual single strands. A sample of the drug substance is accurately weighed, dissolved, and diluted volumetrically in water. The absorbance is measured in a quartz cell using a UV spectrophotometer. The total oligonucleotide assay value is calculated using the experimentally determined molar absorptivity of the working standard and reported in micrograms of sodium oligonucleotide per milligram of solid drug substance.

Purity Tests: Purity will be measured using one or more chromatographic methods. Depending on the separation and the number of nucleic acid analogs of the drug substance present, orthogonal separation methods may be employed to monitor purity of the API. Separation may be achieved by the following means:

SAX-HPLC: an ion exchange interaction between the oligonucleotide phosphodiesters and a strong anion exchange HPLC column using a buffered salt gradient to perform the separation.

RP-HPLC: a partitioning interaction between the oligonucleotide and a hydrophobic reversed-phase HPLC column using an aqueous buffer versus organic solvent gradient to perform the separation.

Capillary Gel Electrophoresis (CGE): an electrophoretic separation by molecular sieving in a buffer solution within a gel filled capillary. Separation occurs as an electrical field is applied, causing anionic oligonucleotides to separate by molecular size as they migrate through the gel matrix. In all separation methods, peaks elute generally in order of oligonucleotide length and are detected by UV at 260 nm.

Other Tests

Physical Appearance: The drug substance sample is visually examined. This test determines that the material has the character of a lyophilized solid, identifies the color of the solid, and determines whether any visible contaminants are present.

Bacterial Endotoxins Test: Bacterial endotoxin testing is performed by the *Limulus Amebocyte* Lysate (LAL) assay using the kinetic turbidimetric method in a 96-well plate. Endotoxin limits for the drug substance will be set appropriately such that when combined with the excipients, daily allowable limits for endotoxin in the administered drug product are not exceeded.

Aerobic Bioburden: Aerobic bioburden is performed by a contract laboratory using a method based on USP chapter <61>.

Acetonitrile content: Residual acetonitrile analysis is performed by a contract laboratory using gas chromatography (GC). Acetonitrile is the major organic solvent used in the upstream synthesis step although several other organic reagents are employed in synthesis. Subsequent purification process steps typically remove solvents in the drug substances. Other solvents may be monitored depending on the outcome of process development work. Solvents will be limited within ICH limits.

Water content: Water content is determined by volumetric Karl Fischer (KF) titration using a solid evaporator unit (oven). Water is typically present in nucleic acid drug substances as several percent of the composition by weight, and therefore, will be monitored.

pH: The pH of reconstituted drug substance will be monitored to ensure suitability for human injection.

Ion Content: Testing for sodium, chloride, and phosphate will be performed by a contract laboratory using standard atomic absorption and ion chromatographic methods. General monitoring of ions will be performed to ensure that the osmolality of the drug product incorporating the drug substances will be within an acceptable physiological range.

Metals Content: Testing for pertinent metals is performed by a contract laboratory using a standard method of analysis, Inductively Coupled Plasma (ICP) spectroscopy.

Example 6

RNAi In Vitro Assay to Assess siNA Activity

An in vitro assay that recapitulates RNAi in a cell-free system is used to evaluate siNA constructs targeting target RNA targets. The assay comprises the system described by Tuschl et al., 1999, *Genes and Development*, 13, 3191-3197 and Zamore et al., 2000, *Cell*, 101, 25-33 adapted for use with a target RNA. A *Drosophila* extract derived from syncytial blastoderm is used to reconstitute RNAi activity in vitro. Target RNA is generated via in vitro transcription from an appropriate target expressing plasmid using T7 RNA polymerase or via chemical synthesis as described herein. Sense and antisense siNA strands (for example 20 uM each) are annealed by incubation in buffer (such as 100 mM potassium acetate, 30 mM HEPES-KOH, pH 7.4, 2 mM magnesium acetate) for 1 minute at 90° C. followed by 1 hour at 37° C., then diluted in lysis buffer (for example 100 mM potassium acetate, 30 mM HEPES-KOH at pH 7.4, 2 mM magnesium acetate). Annealing can be monitored by gel electrophoresis on an agarose gel in TBE buffer and stained with ethidium bromide. The *Drosophila* lysate is prepared using zero to two-hour-old embryos from Oregon R flies collected on yeasted molasses agar that are dechorionated and lysed. The lysate is centrifuged and the supernatant isolated. The assay comprises a reaction mixture containing 50% lysate [vol/vol], RNA (10-50 µM final concentration), and 10% [vol/vol] lysis buffer containing siNA (10 nM final concentration). The reaction mixture also contains 10 mM creatine phosphate, 10 ug/ml creatine phosphokinase, 100 um GTP, 100 uM UTP, 100 uM CTP, 500 uM ATP, 5 mM DTT, 0.1 U/uL RNasin (Promega), and 100 uM of each amino acid. The final concentration of potassium acetate is adjusted to 100 mM. The reactions are pre-assembled on ice and preincubated at 25° C. for 10 minutes before adding RNA, then incubated at 25° C. for an additional 60 minutes. Reactions are quenched with 4 volumes of 1.25× Passive Lysis Buffer (Promega). Target RNA cleavage is assayed by RT-PCR analysis or other methods known in the art and are compared to control reactions in which siNA is omitted from the reaction.

Alternately, internally-labeled target RNA for the assay is prepared by in vitro transcription in the presence of [alpha-$^{32}$P] CTP, passed over a G50 Sephadex column by spin chromatography and used as target RNA without further purification. Optionally, target RNA is 5'-$^{32}$P-end labeled using T4 polynucleotide kinase enzyme. Assays are performed as described above and target RNA and the specific RNA cleavage products generated by RNAi are visualized on an autoradiograph of a gel. The percentage of cleavage is determined by PHOSPHOR IMAGER® (autoradiography) quantitation of bands representing intact control RNA or RNA from control reactions without siNA and the cleavage products generated by the assay.

In one embodiment, this assay is used to determine target sites in the target RNA target for siNA mediated RNAi cleavage, wherein a plurality of siNA constructs are screened for RNAi mediated cleavage of the target RNA target, for example, by analyzing the assay reaction by electrophoresis of labeled target RNA, or by northern blotting, as well as by other methodology well known in the art.

Example 7

Nucleic Acid Inhibition of HCV Target RNA In Vivo siNA molecules targeted to the human HCV RNA are designed and synthesized as described above. These nucleic acid molecules can be tested for cleavage activity in vivo, for example, using the following procedure. The target sequences and the nucleotide location within the HCV RNA are given in Tables II and III.

Two formats are used to test the efficacy of siNAs targeting HCV. First, the reagents are tested in cell culture using, for example, human hepatoma (Huh7) cells, to determine the extent of RNA and protein inhibition. siNA reagents (e.g.; see Tables II and III) are selected against the HCV target as described herein. RNA inhibition is measured after delivery of these reagents by a suitable transfection agent to, for example, cultured epidermal keratinocytes. Relative amounts of target RNA are measured versus actin using real-time PCR monitoring of amplification (eg., ABI 7700 TAQMAN®). A comparison is made to a mixture of oligonucleotide sequences made to unrelated targets or to a randomized siNA control with the same overall length and chemistry, but randomly substituted at each position. Primary and secondary lead reagents are chosen for the target and optimization performed. After an optimal transfection agent concentration is chosen, a RNA time-course of inhibition is performed with the lead siNA molecule. In addition, a cell-plating format can be used to determine RNA inhibition.

In addition, a cell-plating format can be used to determine RNA inhibition. This system is described in Rice et al., U.S. Pat. No. 5,874,565 and U.S. Pat. No. 6,127,116, both incorporated by reference herein.

Delivery of siNA to Cells

Huh7b cells stably transfected with the HCV subgenomic replicon Clone A or Ava.5 are seeded, for example, at 8.5×10$^3$ cells per well of a 96-well platein DMEM(Gibco) the day before transfection. siNA (final concentration, for example 25 nM) and cationic lipid Lipofectamine2000 (e.g., final concentration 0.5 µl/well) are complexed in Optimem (Gibco) at 37° C. for 20 minutes inpolypropelyne microtubes. Following vortexing, the complexed siNA is added to each well and incubated for 24-72 hours.

TAQMAN® (Real-Time PCR Monitoring of Amplification) and Lightcycler Quantification of mRNA Total RNA is prepared from cells following siNA delivery, for example, using Qiagen RNA purification kits for 6-well or Rneasy extraction kits for 96-well assays. For TAQMAN® analysis (real-time PCR monitoring of amplification), dual-labeled probes are synthesized with the reporter dye, FAM or JOE, covalently linked at the 5'-end and the quencher dye TAMRA conjugated to the 3'-end. One-step RT-PCR amplifications are performed on, for example, an ABI PRISM 7700 Sequence Detector using 50 µl reactions consisting of 10 µl total RNA, 100 nM forward primer, 900 nM reverse primer, 100 nM probe, 1× TaqMan PCR reaction buffer (PE-Applied Biosystems), 5.5 mM MgCl$_2$, 300 µM each dATP, dCTP, dGTP, and dTTP, 10 U RNase Inhibitor (Promega), 1.25 U AMPLITAQ GOLD® (DNA polymerase) (PE-Applied Biosystems) and 10 U M-MLV Reverse Transcriptase (Promega). The thermal cycling conditions can consist of 30 minutes at 48° C., 10 minutes at 95° C., followed by 40 cycles of 15 seconds at 95° C. and 1 minute at 60° C. Quantitation of mRNA levels is determined relative to standards generated from serially diluted total cellular RNA (300, 100, 33, 11 ng/reaction) and normalizing to 13-actin or GAPDH mRNA in parallel TAQMAN® reactions (real-time PCR monitoring of amplification). For each gene of interest an upper and lower primer and a fluorescently labeled probe are designed. Real time incorporation of SYBR Green I dye into a specific PCR product can be measured in glass capillary tubes using a lightcyler. A standard curve is generated for each primer pair using control cRNA. Values are represented as relative expression to GAPDH in each sample.

Western Blotting

Total RNA is prepared from cells following siNA delivery, for example, using Ambion Rnaqueous 4-PCR purification kit for large scale extractions, or Ambion Rnaqueous-96 purification kit for 96-well assays. For Taqman analysis, dual-labeled probes are synthesized with, for example, the reporter dyes FAM or VIC covalently linked at the 5'-end and the quencher dye TAMARA conjugated to the 3'-end. One-step RT-PCR amplifications are performed on, for example, an ABI PRISM 7700 Sequence detector using 50 uL reactions consisting of 10 uL total RNA, 100 nM forward primer, 100 nM reverse primer, 100 nM probe, 1× TaqMan PCR reaction buffer (PE-Applied Biosystems), 5.5 mM MgCl2, 100 uM each dATP, dCTP, dGTP and dTTP, 0.2 U RNase Inhibitor (Promega), 0.025 U AmpliTaq Gold (PE-Applied Biosystems) and 0.2 U M-MLV Reverse Transcriptase (Promega). The thermal cycling conditions can consist of 30 minutes at 48° C., 10 minutes at 95° C., followed by 40 cycles of 15 seconds at 95° C. and 1 minute at 60° C. Quantitation of target mRNA level is determined relative to standards generated from serially diluted total cellular RNA (300, 100, 30, 10 ng/rxn) and normalizing to, for example, 36B4 mRNA in either parallel or same tube TaqMan reactions. For HCV Replicon mRNA quantitation, PCR primers and probe specific for the neomycin gene were used:

```
                                          (SEQ ID NO: 2150)
neo-forward primer, 5'-CCGGCTACCTGCCCATTC-3';

(SEQ ID NO: 2151)
neo-reverse primer, 5'-CCAGATCATCCTGATCGACAAG-3';

(SEQ ID NO: 2152)
neo-probe,
5'FAM-ACATCGCATCGAGCGAGCACGTAC-TAMARA3';
```

For normalization, 36B4 PCR primers and probe were used:

```
                                          (SEQ ID NO: 2153)
36B4-forward primer,
5'-TCTATCATCAACGGGTACAAACGA-3';

(SEQ ID NO: 2154)
36B4 reverse primer, 5'-CTTTTCAGCAAGTGGGAAGGTG-3';

(SEQ ID NO: 2155)
36B4 probe,
5'VIC-CCTGGCCTTGTCTGTGGAGACGGATTA-TAMARA3';
```

Example 8

Models Useful to Evaluate the Down-Regulation of HCV Gene Expression

Cell Culture

Although there have been reports of replication of HCV in cell culture (see below), these systems are difficult to reproduce and have proven unreliable. Therefore, as was the case for development of other anti-HCV therapeutics, such as interferon and ribavirin, after demonstration of safety in animal studies applicant can proceed directly into a clinical feasibility study.

Several recent reports have documented in vitro growth of HCV in human cell lines (Mizutani et al., Biochem Biophys Res Commun 1996 227(3):822-826; Tagawa et al., Journal of Gasteroenterology and Hepatology 1995 10(5):523-527; Cribier et al., Journal of General Virology 76(10):2485-2491; Seipp et al., Journal of General Virology 1997 78(10):2467-2478; Iacovacci et al., Research Virology 1997 148(2):147-151; Iocavacci et al., Hepatology 1997 26(5) 1328-1337; Ito et al., Journal of General Virology 1996 77(5):1043-1054; Nakajima et al., Journal of Virology 1996 70(5):3325-3329; Mizutani et al., Journal of Virology 1996 70(10):7219-7223; Valli et al., Res Virol 1995 146(4): 285-288; Kato et al., Biochem Biophys Res Comm 1995 206(3):863-869). Replication of HCV has been reported in both T and B cell lines, as well as cell lines derived from human hepatocytes. Detection of low level replication was documented using either RT-PCR based assays or the b-DNA assay. It is important to note that the most recent publications regarding HCV cell cultures document replication for up to 6-months. However, the level of HCV replication observed in these cell lines has not been robust enough for screening of antiviral compounds.

In addition to cell lines that can be infected with HCV, several groups have reported the successful transformation of cell lines with cDNA clones of full-length or partial HCV genomes (Harada et al., Journal of General Virology, 1995, 76(5)1215-1221; Haramatsu et al., Journal of Viral Hepatitis 1997 4S(1):61-67; Dash et al., American Journal of Pathology 1997 151(2):363-373; Mizuno et al., Gasteroenterology 1995 109(6):1933-40; Yoo et al., Journal Of Virology 1995 69(1):32-38).

The recent development of subgenomic HCV RNA replicons capable of successfully replicating in the human hepatoma cell line, Huh7, represents a significant advance toward a dependable cell culture model. These replicons contain the neomycin gene upstream of the HCV nonstructural genes allowing for the selection of replicative RNAs in Huh7 cells. Initially, RNA replication was detected at a low frequency (Lohmann et al. Science 1999 285: 110-113) but the identification of replicons with cell-adaptive mutations in the NS5A region has improved the efficiency of replication 10.000-fold (Blight et al. Science 2000 290: 1972-1975). Steps in the HCV life cycle, such as translation, protein processing, and RNA replication are recapitulated in the subgenomic replicon systems, but early events (viral attachment and uncoating) and viral assembly is absent. Inclusion of the structural genes of HCV within the replicons results in the production of HCV core and envelope proteins, but virus assembly does not occur (Pietschmann et al. Journal of Virology 2002 76: 4008-4021). Such replicon systems have been used to study siRNA mediated inhibition of HCV RNA, see for example, Randall et al., 2003, *PNAS USA,* 100, 235-240.

In several cell culture systems, cationic lipids have been shown to enhance the bioavailability of oligonucleotides to cells in culture (Bennet, et al., 1992, Mol. Pharmacology, 41, 1023-1033). In one embodiment, siNA molecules of the invention are complexed with cationic lipids for cell culture experiments. siNA and cationic lipid mixtures are prepared in serum-free DMEM immediately prior to addition to the cells. DMEM plus additives are warmed to room temperature (about 20-25° C.) and cationic lipid is added to the final desired concentration and the solution is vortexed briefly. siNA molecules are added to the final desired concentration and the solution is again vortexed briefly and incubated for 10 minutes at room temperature. In dose response experiments, the RNA/lipid complex is serially diluted into DMEM following the 10 minute incubation.

Animal Models

Evaluating the efficacy of anti-HCV agents in animal models is an important prerequisite to human clinical trials. The best characterized animal system for HCV infection is the chimpanzee. Moreover, the chronic hepatitis that results from HCV infection in chimpanzees and humans is very similar. Although clinically relevant, the chimpanzee model suffers from several practical impediments that make use of this model difficult. These include high cost, long incubation requirements and lack of sufficient quantities of animals. Due to these factors, a number of groups have attempted to develop rodent models of chronic hepatitis C infection. While direct infection has not been possible, several groups have reported on the stable transfection of either portions or entire HCV genomes into rodents (Yamamoto et al., Hepatology 1995 22(3): 847-855; Galun et al., Journal of Infectious Disease 1995 172(1):25-30; Koike et al., Journal of general Virology 1995 76(12)3031-3038; Pasquinelli et al., Hepatology 1997 25(3): 719-727; Hayashi et al., Princess Takamatsu Symp 1995 25:1430149; Mariya et al., Journal of General Virology 1997 78(7) 1527-1531; Takehara et al., Hepatology 1995 21(3):746-751; Kawamura et al., Hepatology 1997 25(4): 1014-1021). In addition, transplantation of HCV infected human liver into immunocompromised mice results in prolonged detection of HCV RNA in the animal's blood.

A method for expressing hepatitis C virus in an in vivo animal model has been developed (Vierling, International PCT Publication No. WO 99/16307). Viable, HCV infected human hepatocytes are transplanted into a liver parenchyma of a scid/scid mouse host. The scid/scid mouse host is then maintained in a viable state, whereby viable, morphologically intact human hepatocytes persist in the donor tissue and hepatitis C virus is replicated in the persisting human hepatocytes. This model provides an effective means for the study of HCV inhibition by enzymatic nucleic acids in vivo.

As such, these models can be used in evaluating the efficacy of siNA molecules of the invention in inhibiting HCV expression. These models and others can similarly be used to evaluate the safety and efficacy of siNA molecules of the invention in a pre-clinical setting.

Example 9

RNAi Mediated Inhibition of Target Gene Expression

In Vitro siNA Mediated Inhibition of Target RNA siNA constructs (Table III) are tested for efficacy in reducing HCV RNA expression in, for example, Huh7 cells. Cells are plated approximately 24 hours before transfection in 96-well plates at 5,000-7,500 cells/well, 100 μl/well, such that at the time of transfection cells are 70-90% confluent. For transfection, annealed siNAs are mixed with the transfection reagent (Lipofectamine 2000, Invitrogen) in a volume of 50 μl/well and incubated for 20 minutes at room temperature. The siNA transfection mixtures are added to cells to give a final siNA concentration of 25 nM in a volume of 150 μl. Each siNA transfection mixture is added to 3 wells for triplicate siNA treatments. Cells are incubated at 37° for 24 hours in the continued presence of the siNA transfection mixture. At 24 hours, RNA is prepared from each well of treated cells. The supernatants with the transfection mixtures are first removed and discarded, then the cells are lysed and RNA prepared from each well. Target gene expression following treatment is evaluated by RT-PCR for the target gene and for a control gene (36B4, an RNA polymerase subunit) for normalization. The triplicate data is averaged, and the standard deviations determined for each treatment. Normalized data are graphed and the percent reduction of target mRNA by active siNAs in comparison to their respective inverted control siNAs is determined.

Example 10

Evaluation of siNA Molecules in Marmosets

GBV-B is very closely related to human hepatitis C virus and causes hepatitis in tamarins and marmosets. Thus, GBV-B provides a small animal model for testing antiviral compounds and vaccines for HCV infection. This study investigated the efficacy of LNP formulated double stranded siNA molecules targeting HCV RNA sites 293 and 316. The GBV-B model is an excellent system to test whether this therapy is likely to work on humans chronically infected with HCV.

In the study, 2 animals were inoculated with GBV-B and IV treatment with the active formulated siNA (Sirna Compound Nos. 33149/47677 and 31703/38756, Formulation LNP-086; see Tables III and VI) at 3 mg/kg was initiated one day post infection. Active compositions were formulated as is described in U.S. Provisional patent application No. 60/737,024, filed Nov. 15, 2005. Another 2 animals were inoculated with GBV-B and were untreated to serve as negative controls. The animals were monitored to determine the effect of the therapy of GBV-B infection. Blood draws were performed over the course of the study to determine viral titers. Dosing of formulated siNA in the treated animals was repeated at days 1, 3, and 7 after inoculation at day 0. These animals show a profound inhibition of GBV-B over a three week time course compared to the untreated control animals (see FIG. 30). In addition, an animal with established GBV infection was treated with active formulated siNA (Sirna Compound Nos. 33149/47677 and 31703/38756, Formulation LNP-086; see Tables III and VI) at days 28, 31, and 35 post infection. This animal showed a decrease in viral titer down to the limit of detection following the dosing of active compound (see FIG. 31) compared to historic untreated controls.

Example 11

Evaluation of siNA Molecules in Chimpanzees

This study is used to evaluate double stranded nucleic acid antiviral formulations for the ability to suppress hepatitis C virus (HCV) replication in HCV-infected chimpanzees. The compound formulation contains siNA directed at the HCV viral genome and that mediates degradation of the viral RNA via RNA interference. The compound is administered by IV. The chimpanzees to be used are selected from a group of HCV chronic animals. The study is conducted in two phases: pharmacokinetics and efficacy.

The pharmacokinetics portion of the study is conducted in two non-HCV-infected animals. Blood samples are obtained at time 0, 15 min, 30 min, 24 hr, and days 3, 7 and 14. Liver biopsies are obtained at 24 hr and 14 days. The efficacy involves testing of the antiviral compound in 2 or more HCV infected chimpanzees.

Animals receive 4 weekly IV injections with the antiviral siNA formulation. Blood samples are obtained at −4, −2, and 0 weeks, then weekly for 6 weeks, and then every other week for 4 additional weeks. Liver biopsies are obtained at −4 weeks and +4 weeks (one week after last injection). A blood and tissue sampling schedule is shown below. The animals are monitored for blood chemistries and CBC at all bleeds. At the sign of any serious adverse effects, treatment is stopped. For each animal, a total of 11 blood samples are requested to monitor the viral RNA levels in the serum. Liver needle biopsies are requested at two time points for analysis of viral RNA load in the liver, level of siNA compound targeted to liver, the presence of siNA induced viral RNA cleavage products, and changes in liver gene expression. Viral RNA is monitored by real time TaqMan quantitative RT-PCR. Serum samples are extracted in duplicate and run in quadruplicate. Liver RNA levels are run in duplicate.

Schedule for SINA PK Study in 2 Uninfected Chimpanzees

| Days Weeks Biopsy | Dosing IV | Serum | CBC | Chemistries | Liver |
|---|---|---|---|---|---|
| Day 0, | X | 10 ml | 2 ml | 3 ml | |
| Day 0, 15 min | | 10 ml | 2 ml | 3 ml | |
| Day 0, 30 min | | 10 ml | 2 ml | 3 ml | |
| Day 1, 24 hr | | 10 ml | 2 ml | 3 ml | X |
| Day 3 | | 10 ml | 2 ml | 3 ml | |
| Day 7 | | 10 ml | 2 ml | 3 ml | |
| Day 14 | | 10 ml | 2 ml | 3 ml | X |

Blood, 1 x SST tube to Lanford Lab. Processed in 1 ml frozen aliquots.
Biopsies frozen.

Schedule for SINA Efficacy Study in 2 HCV Chronic Chimpanzees

| Weeks Biopsy | Dosing IV | Serum | CBC | Chemistries | Liver |
|---|---|---|---|---|---|
| Pre-4 |   | 20 ml | 2 ml | 3 ml | X |
| Pre-2 |   | 20 ml | 2 ml | 3 ml |   |
| Day 0, Wk0 | X | 20 ml | 2 ml | 3 ml |   |
| Day 7, Wk1 | X | 20 ml | 2 ml | 3 ml |   |
| Wk 2 | X | 20 ml | 2 ml | 3 ml |   |
| Wk 3 | X | 20 ml | 2 ml | 3 ml |   |
| Wk 4 |   | 20 ml | 2 ml | 3 ml | X |
| Wk 5 |   | 20 ml | 2 ml | 3 ml |   |
| Wk 6 |   | 20 ml | 2 ml | 3 ml |   |
| Wk 8 |   | 20 ml | 2 ml | 3 ml |   |
| Wk 10 |   | 20 ml | 2 ml | 3 ml |   |

Blood, 2 x SST tube to Lanford Lab. Processed in 1 ml frozen aliquots.
Biopsies frozen. Divided in half, process half for RNA with RNAzol for viral RNA.

Example 12

Safety, Tolerability, PK, PD and Anti-Viral Effects of Single and Multiple Dose Administration of SIRNA-AV34 in Interferon-Naïve and Experienced Patients with Chronic HCV Infection The primary objective of this study are to establish the MTD of single and multiple doses of Sirna-034 in HCV-positive patients. A secondary objective is to evaluate the single dose and steady-state pharmacokinetics of Sirna-034; to evaluate the pharmacodynamics of single and multiple doses of Sirna-034; and to assess the effect of single and multiple doses of Sirna-034 on indices of viral replication and infectivity.

This is a Phase I/II, randomized, double-blind, placebo-controlled, single- and multiple-dose escalation study of Sirna-034 in patients with chronic hepatitis C infection and compensated hepatic function. Patients meeting eligibility criteria are be enrolled into 4-6 sequential groups for the SAD portion of the study. Each patient is admitted to a clinical research unit for treatment administration and discharged 36 hours after dosing unless further intensive monitoring is considered necessary by the investigator. Patients have daily visits to the clinic for five additional days, and receive a follow-up phone call for SAEs 30 days after dosing. Dose escalation is dependent on safety parameters (physical examination findings, vital signs, adverse events, and laboratory values) from the preceding group.

At screening for the SAD phase, patients undergo phlebotomy for assessment of serum chemistry, hematology, coagulation parameters, serum beta-HCG (women only), HIV antibody status, HBsAg, alpha feto-protein, quantitative HCV viral RNA and HCV genotyping, and provide urine for urinalysis. During the treatment phase, clinical laboratories (chemistry, hematology, coagulation parameters and urinalysis) are assessed pre-dose, and 24 hours, 3d and 6d after dosing. ECG are assessed pre-dose and 4-6 hours and 6 days after dosing. Physical exam is conducted pre-dose and 6 days after dosing. Serum samples for PK analysis are collected pre-dose, and 30 minutes, 1, 2, 3, 4, 6, 8, 12, 24 and 36 hours, and 2, 3, 4, 5, and 6 days after dosing. Assessments of viral RNA and potentially another marker of viral infectivity is performed pre-dose and 1, 2, 3, 4, 5, and 6 days after dosing.

Once the dose of Sirna-034 that is well-tolerated results in approximately 90% reduction in viral load has been determined, patients are enrolled into the MAD portion of the study. Patients from the SAD portion of the study who choose to participate in the MAD phase undergo limited re-screening consisting of interval history, physical exam, clinical laboratory assessment, and quantitative HCV viral RNA. New enrollees undergo full re-screening as outlined for the SAD phase, above. Patients enrolled in once weekly dosing regimen visit the study site weekly×4, 7 days after the last dose, and receive a telephone call for SAEs 30d after the last dose. Patients randomized to an every other week dosing regimen visit the study site 2 times and have similar post-treatment follow-up. Dose escalation is dependent on safety parameters (physical examination findings, vital signs, adverse events, and laboratory values) from the preceding group.

During the MAD treatment phase, clinical laboratories (chemistry, hematology, coagulation parameters and urinalysis) are assessed prior to administration of each dose, and 7 days after the last dose. ECG is assessed before the first dose, and 7 days after the last dose. Physical exam is conducted pre-dose, after the last dose and 7 days after the last dose. Serum samples for PK analysis are collected before and 2, 4, 8, 12 and 24 hours after the first dose, before each subsequent dose, and 2, 4, 8, 12 and 24 hours and 7 days after the last dose. Assessments of viral RNA and potentially another marker of viral infectivity is performed prior to the first dose and then weekly up to 7 days after the last dose.

Diagnosis and Main Criteria for Inclusion/Exclusion:

Men and women who are not of child-bearing potential; 18 to 60 years of age; HCV-positive; elevated ALT at screening and on one other occasion within the prior 6 months; HIV negative; HBsAg negative; normal PT, PTT, hemoglobin, bilirubin, albumin and alpha feto-protein; platelet count >100K; no other known cause of liver disease; either interferon naïve, relapsed after interferon, or non-responder to interferon.

Dosage and Mode of Administration:

Liquid solution for IV injection, 0.1 to 10 mg/ml of Sirna-034. For the SAD portion of the study, the starting dose is TBD, but estimate 1/50 of NOAEL from 4 week monkey toxicology study. Dose to be escalated to MTD. For the MAD portion of the study, the single dose that produces 90% reduction of viral load, if well-tolerated as single doses, will be administered to sequential cohorts dosed either weekly or every other week×4 weeks.

Duration of Patient Participation/Duration of Study/Duration of Treatment:

For SAD period, duration of treatment will be 42 days (range, 38 to 49) consisting of a 1-14 day screening period, 1-day treatment with 36 hours in inpatient observation, five additional days of outpatient observation and 30 day SAE follow-up (via telephone). During the MAD phase, the same patients, as well as newly-recruited patients as necessary, will be treated for 72 days (range, 65 to 79) consisting of a 0-14 day screening period, 4 week treatment period, 7 day follow-up period and 30 day SAE follow-up (via telephone). As a result, the duration of patient participation for those patients enrolled in both phases of the study may be up to 128 days, not including any intervening periods between the SAD and MAD portions of the study.

Reference Therapy, Dosage and Mode of Administration:

Placebo will be formulated as a liquid solution for IV injection and be identical in appearance to Sirna-034

Criteria for Evaluation

For Efficacy and Pharmacodynamics, HCV viral RNA will be evaluated possibly along with a novel biologic marker of HCV capsid protein processing or viral infectivity. For Safety, vital signs, adverse events, standard laboratory tests, and physical examinations will be monitored.

Statistical Methods

Incidence of adverse events, signs, symptoms, ECG parameters and laboratory findings; descriptive statistics of changes in ECG parameters and laboratory values, PK and PD parameters; and exploratory analyses of measures of viral load, replication and infectivity.

The main objective of the Clinical Plan is to assess the safety and efficacy of Sirna-034 as a potential treatment for Chronic Hepatitis C in such a way as to support the Target Profile (TP) and meet requirements for registration. The total number of subjects to be studied in the entire plan is about 1200

This CP for Sirna-034 s designed to validate the TP and to meet regulatory requirements for registration as a treatment for Chronic Hepatitis C. The initial claim will be that Sirna-034 is indicated for the treatment of Chronic Hepatitis C in combination with PEG-Interferon and ribavirin in patient non responding to PEG-Interferon and ribavirin, who have compensate liver disease and 18 year of age and older.

A Phase I/II Dose Escalation study in patients with compensated and previously treated or untreated chronic hepatitis C will establish the safety of multiple dose administration (weekly ascending doses for 4 week or every two weeks for four weeks), the extent of systemic exposure to the compound, and establish a "proof of mechanism" as effective monotherapy through analysis of serum HCV RNA (reduction of 1-2 logs)

This will be followed by a formal Phase II dose finding study in combination PEG-Interferon and ribavirin in clinically active hepatitis C patients non responding to PEG-Interferon and ribavirin. The 48-week study will provide data on the safety, effectiveness and PK of the triple combination, with Sirna-034 administered weekly.

The Phase III studies will be randomized, placebo-controlled studies which will confirm evidence of efficacy and provide further safety data of the compound. Two pivotal randomized, placebo-controlled multi-national Phase III studies will be designed to confirm efficacy and provide safety data to support registration. Primary efficacy endpoints will be at 24 weeks following the end of 48-week treatment, represented by undetectable HCV RNA and normalization of ALT. At the time of registration, over 1200 patients will have been exposed to Sirna-034.

Sirna-034 is a modified anti-HCV siNA consisting of two Sirna duplexes (Sirna Compound Nos. 33149/47677 and 31703/38756, (SEQ ID NOs: 1796/2102 and 1677/2103) formulated as LNP-086, which consists of CLinDMA/DSPC/Cholesterol/PEG-DMG/Linoleyl alcohol in a molar ration of 43/38/10/2/7; see Tables III and VI) that has the potential to inhibit HCV replication. Sirna-034 targets HCV mRNA sites 293 and 316. Sirna-034 is expected to improve the patient's overall symptomatic response to conventional therapy (PEG-Interferon and ribavirin), and will provide the best opportunity to safely minimize a subject's susceptibility to the risk of the disability, morbidity and mortality caused by HCV infection.

Example 13

Indications

The present body of knowledge in HCV research indicates the need for methods to assay HCV activity and for compounds that can regulate HCV expression for research, diagnostic, and therapeutic use. As described herein, the nucleic acid molecules of the present invention can be used in assays to diagnose disease state related of HCV levels. In addition, the nucleic acid molecules can be used to treat disease state related to HCV levels.

Particular degenerative and disease states that can be associated with HCV expression modulation include, but are not limited to, HCV infection, liver failure, hepatocellular carcinoma, cirrhosis, and/or other disease states associated with HCV infection.

Example 14

Interferons

Interferons represent a non-limiting example of a class of compounds that can be used in conjunction with the siNA molecules of the invention for treating the diseases and/or conditions described herein. Type I interferons (IFN) are a class of natural cytokines that includes a family of greater than 25 IFN-α (Pesta, 1986, *Methods Enzymol.* 119, 3-14) as well as IFN-β, and IFN-ω. Although evolutionarily derived from the same gene (Diaz et al., 1994, Genomics 22, 540-552), there are many differences in the primary sequence of these molecules, implying an evolutionary divergence in biologic activity. All type I IFN share a common pattern of biologic effects that begin with binding of the IFN to the cell surface receptor (Pfeffer & Strulovici, 1992, Transmembrane secondary messengers for IFN-α/β. In: Interferon. Principles and Medical Applications., S. Baron, D. H. Coopenhaver, F. Dianzani, W. R. Fleischmann Jr., T. K. Hughes Jr., G. R. Kimpel, D. W. Niesel, G. J. Stanton, and S. K. Tyring, eds. 151-160). Binding is followed by activation of tyrosine kinases, including the Janus tyrosine kinases and the STAT proteins, which leads to the production of several IFN-stimulated gene products (Johnson et al., 1994, *Sci. Am.* 270, 68-75). The IFN-stimulated gene products are responsible for the pleotropic biologic effects of type I IFN, including antiviral, antiproliferative, and immunomodulatory effects, cytokine induction, and HLA class I and class II regulation (Pestka et al., 1987, *Annu. Rev. Biochem* 56, 727). Examples of IFN-stimulated gene products include 2-5-oligoadenylate synthetase (2-50AS), β2-microglobulin, neopterin, p68 kinases, and the Mx protein (Chebath & Revel, 1992, The 2-5 A system: 2-5 A synthetase, isospecies and functions. In: Interferon. Principles and Medical Applications, S. Baron, D. H. Coopenhaver, F. Dianzani, W. R. Jr. Fleischmann, T. K. Jr Hughes, G. R. Kimpel, D. W. Niesel, G. J. Stanton, and S. K. Tyring, eds., pp. 225-236; Samuel, 1992, The RNA-dependent P1/elF-2α protein kinase. In: Interferon. Principles and Medical Applications. S. Baron, D. H. Coopenhaver, F. Dianzani, W. R. Fleischmann Jr., T. K. Hughes Jr., G. R. Kimpel, D. W. Niesel, G. H. Stanton, and S. K. Tyring, eds. 237-250; Horisberger, 1992, MX protein: function and Mechanism of Action. In: Interferon. Principles and Medical Applications. S. Baron, D. H. Coopenhaver, F. Dianzani, W. R. Fleischmann Jr., T. K. Hughes Jr., G. R. Kimpel, D. W. Niesel, G. H. Stanton, and S. K. Tyring, eds. 215-224). Although all type I IFN have similar biologic effects, not all the activities are shared by each type I IFN, and in many cases, the extent of activity varies quite substantially for each IFN subtype (Fish et al, 1989, *J. Interferon Res.* 9, 97-114; Ozes et al., 1992, J. Interferon Res. 12, 55-59). More specifically, investigations into the properties of different subtypes of IFN-α and molecular hybrids of IFN-α have shown differences in pharmacologic properties (Rubinstein, 1987, J. Interferon Res. 7, 545-551). These pharmacologic differences can arise from as few as three amino acid residue changes (Lee et al., 1982, Cancer Res. 42, 1312-1316).

Eighty-five to 166 amino acids are conserved in the known IFN-α subtypes. Excluding the IFN-ααpseudogenes, there are approximately 25 known distinct IFN-α subtypes. Pairwise comparisons of these nonallelic subtypes show primary sequence differences ranging from 2% to 23%. In addition to the naturally occurring IFNs, a non-natural recombinant type I interferon known as consensus interferon (CIFN) has been synthesized as a therapeutic compound (Tong et al., 1997, *Hepatology* 26, 747-754).

Interferon is currently in use for at least 12 different indications, including infectious and autoimmune diseases and cancer (Borden, 1992, N. Engl. J. Med. 326, 1491-1492). For autoimmune diseases, IFN has been utilized for treatment of rheumatoid arthritis, multiple sclerosis, and Crohn's disease. For treatment of cancer, IFN has been used alone or in combination with a number of different compounds. Specific types of cancers for which IFN has been used include squamous cell carcinomas, melanomas, hypernephromas, hemangiomas, hairy cell leukemia, and Kaposi's sarcoma. In the treatment of infectious diseases, IFNs increase the phagocytic activity of macrophages and cytotoxicity of lymphocytes and inhibits the propagation of cellular pathogens. Specific indications for which IFN has been used as treatment include hepatitis B, human papillomavirus types 6 and 11 (i.e. genital warts) (Leventhal et al., 1991, N Engl J Med 325, 613-617), chronic granulomatous disease, and hepatitis C virus.

Numerous well controlled clinical trials using IFN-alpha in the treatment of chronic HCV infection have demonstrated that treatment three times a week results in lowering of serum ALT values in approximately 50% (range 40% to 70%) of patients by the end of 6 months of therapy (Davis et al., 1989, N. Engl. J. Med. 321, 1501-1506; Marcellin et al., 1991, Hepatology 13, 393-397; Tong et al., 1997, Hepatology 26, 747-754; Tong et al., Hepatology 26, 1640-1645). However, following cessation of interferon treatment, approximately 50% of the responding patients relapsed, resulting in a "durable" response rate as assessed by normalization of serum ALT concentrations of approximately 20 to 25%. In addition, studies that have examined six months of type I interferon therapy using changes in HCV RNA values as a clinical endpoint have demonstrated that up to 35% of patients will have a loss of HCV RNA by the end of therapy (Tong et al., 1997, supra). However, as with the ALT endpoint, about 50% of the patients relapse six months following cessation of therapy resulting in a durable virologic response of only 12% (23). Studies that have examined 48 weeks of therapy have demonstrated that the sustained virological response is up to 25%.

Pegylated interferons, i.e., interferons conjugated with polyethylene glycol (PEG), have demonstrated improved characteristics over interferon. Advantages incurred by PEG conjugation can include an improved pharmacokinetic profile compared to interferons lacking PEG, thus imparting more convenient dosing regimes, improved tolerance, and improved antiviral efficacy. Such improvements have been demonstrated in clinical studies of both polyethylene glycol interferon alfa-2a (PEGASYS, Roche) and polyethylene glycol interferon alfa-2b (VIRAFERON PEG, PEG-INTRON, Enzon/Schering Plough).

siNA molecules in combination with interferons and polyethylene glycol interferons have the potential to improve the effectiveness of treatment of HCV or any of the other indications discussed above. siNA molecules targeting RNAs associated with HCV infection can be used individually or in combination with other therapies such as interferons and polyethylene glycol interferons and to achieve enhanced efficacy.

Example 15

Multifunctional siNA Inhibition of Target RNA Expression

Multifunctional siNA Design

Once target sites have been identified for multifunctional siNA constructs, each strand of the siNA is designed with a complementary region of length, for example, of about 18 to about 28 nucleotides, that is complementary to a different target nucleic acid sequence. Each complementary region is designed with an adjacent flanking region of about 4 to about 22 nucleotides that is not complementary to the target sequence, but which comprises complementarity to the complementary region of the other sequence (see for example FIG. 16). Hairpin constructs can likewise be designed (see for example FIG. 17). Identification of complementary, palindrome or repeat sequences that are shared between the different target nucleic acid sequences can be used to shorten the overall length of the multifunctional siNA constructs (see for example FIGS. 18 and 19).

In a non-limiting example, three additional categories of additional multifunctional siNA designs are presented that allow a single siNA molecule to silence multiple targets. The first method utilizes linkers to join siNAs (or multiunctional siNAs) in a direct manner. This can allow the most potent siNAs to be joined without creating a long, continuous stretch of RNA that has potential to trigger an interferon response. The second method is a dendrimeric extension of the overlapping or the linked multifunctional design; or alternatively the organization of siNA in a supramolecular format. The third method uses helix lengths greater than 30 base pairs. Processing of these siNAs by Dicer will reveal new, active 5' antisense ends. Therefore, the long siNAs can target the sites defined by the original 5' ends and those defined by the new ends that are created by Dicer processing. When used in combination with traditional multifunctional siNAs (where the sense and antisense strands each define a target) the approach can be used for example to target 4 or more sites.

1. Tethered Bifunctional siNAs

The basic idea is a novel approach to the design of multifunctional siNAs in which two antisense siNA strands are annealed to a single sense strand. The sense strand oligonucleotide contains a linker (e.g., non-nucleotide linker as described herein) and two segments that anneal to the antisense siNA strands (see FIG. 22). The linkers can also optionally comprise nucleotide-based linkers. Several potential advantages and variations to this approach include, but are not limited to:

1. The two antisense siNAs are independent. Therefore, the choice of target sites is not constrained by a requirement for sequence conservation between two sites. Any two highly active siNAs can be combined to form a multifunctional siNA.
2. When used in combination with target sites having homology, siNAs that target a sequence present in two genes (e.g., different isoforms), the design can be used to target more than two sites. A single multifunctional siNA can be for example, used to target RNA of two different target RNAs.
3. Multifunctional siNAs that use both the sense and antisense strands to target a gene can also be incorporated into a tethered multifuctional design. This leaves open the possibility of targeting 6 or more sites with a single complex.
4. It can be possible to anneal more than two antisense strand siNAs to a single tethered sense strand.
5. The design avoids long continuous stretches of dsRNA. Therefore, it is less likely to initiate an interferon response.

6. The linker (or modifications attached to it, such as conjugates described herein) can improve the pharmacokinetic properties of the complex or improve its incorporation into liposomes. Modifications introduced to the linker should not impact siNA activity to the same extent that they would if directly attached to the siNA (see for example FIGS. 27 and 28).
7. The sense strand can extend beyond the annealed antisense strands to provide additional sites for the attachment of conjugates.
8. The polarity of the complex can be switched such that both of the antisense 3' ends are adjacent to the linker and the 5' ends are distal to the linker or combination thereof.

Dendrimer and Supramolecular siNAs

In the dendrimer siNA approach, the synthesis of siNA is initiated by first synthesizing the dendrimer template followed by attaching various functional siNAs. Various constructs are depicted in FIG. 23. The number of functional siNAs that can be attached is only limited by the dimensions of the dendrimer used.

Supramolecular Approach to Multifunctional siNA

The supramolecular format simplifies the challenges of dendrimer synthesis. In this format, the siNA strands are synthesized by standard RNA chemistry, followed by annealing of various complementary strands. The individual strand synthesis contains an antisense sense sequence of one siNA at the 5'-end followed by a nucleic acid or synthetic linker, such as hexaethyleneglycol, which in turn is followed by sense strand of another siNA in 5' to 3' direction. Thus, the synthesis of siNA strands can be carried out in a standard 3' to 5' direction. Representative examples of trifunctional and tetrafunctional siNAs are depicted in FIG. 24. Based on a similar principle, higher functionality siNA constructs can be designed as long as efficient annealing of various strands is achieved.

Dicer Enabled Multifunctional siNA

Using bioinformatic analysis of multiple targets, stretches of identical sequences shared between differing target sequences can be identified ranging from about two to about fourteen nucleotides in length. These identical regions can be designed into extended siNA helixes (e.g., >30 base pairs) such that the processing by Dicer reveals a secondary functional 5'-antisense site (see for example FIG. 25). For example, when the first 17 nucleotides of a siNA antisense strand (e.g., 21 nucleotide strands in a duplex with 3'-TT overhangs) are complementary to a target RNA, robust silencing was observed at 25 nM. 80% silencing was observed with only 16 nucleotide complementarity in the same format.

Incorporation of this property into the designs of siNAs of about 30 to 40 or more base pairs results in additional multifunctional siNA constructs. The example in FIG. 25 illustrates how a 30 base-pair duplex can target three distinct sequences after processing by Dicer-RNaseIII; these sequences can be on the same mRNA or separate RNAs, such as viral and host factor messages, or multiple points along a given pathway (e.g., inflammatory cascades). Furthermore, a 40 base-pair duplex can combine a bifunctional design in tandem, to provide a single duplex targeting four target sequences. An even more extensive approach can include use of homologous sequences to enable five or six targets silenced for one multifunctional duplex. The example in FIG. 25 demonstrates how this can be achieved. A 30 base pair duplex is cleaved by Dicer into 22 and 8 base pair products from either end (8 b.p. fragments not shown). For ease of presentation the overhangs generated by dicer are not shown—but can be compensated for. Three targeting sequences are shown. The required sequence identity overlapped is indicated by grey boxes. The N's of the parent 30 b.p. siNA are suggested sites of 2'-OH positions to enable Dicer cleavage if this is tested in stabilized chemistries. Note that processing of a 30mer duplex by Dicer RNase III does not give a precise 22+8 cleavage, but rather produces a series of closely related products (with 22+8 being the primary site). Therefore, processing by Dicer will yield a series of active siNAs. Another non-limiting example is shown in FIG. 26. A 40 base pair duplex is cleaved by Dicer into 20 base pair products from either end. For ease of presentation the overhangs generated by dicer are not shown—but can be compensated for. Four targeting sequences are shown in four colors, blue, light-blue and red and orange. The required sequence identity overlapped is indicated by grey boxes. This design format can be extended to larger RNAs. If chemically stabilized siNAs are bound by Dicer, then strategically located ribonucleotide linkages can enable designer cleavage products that permit our more extensive repertoire of multifunctional designs. For example cleavage products not limited to the Dicer standard of approximately 22-nucleotides can allow multifunctional siNA constructs with a target sequence identity overlap ranging from, for example, about 3 to about 15 nucleotides.

Example 16

Diagnostic Uses

The siNA molecules of the invention can be used in a variety of diagnostic applications, such as in the identification of molecular targets (e.g., RNA) in a variety of applications, for example, in clinical, industrial, environmental, agricultural and/or research settings. Such diagnostic use of siNA molecules involves utilizing reconstituted RNAi systems, for example, using cellular lysates or partially purified cellular lysates. siNA molecules of this invention can be used as diagnostic tools to examine genetic drift and mutations within diseased cells or to detect the presence of endogenous or exogenous, for example viral, RNA in a cell. The close relationship between siNA activity and the structure of the target RNA allows the detection of mutations in any region of the molecule, which alters the base-pairing and three-dimensional structure of the target RNA. By using multiple siNA molecules described in this invention, one can map nucleotide changes, which are important to RNA structure and function in vitro, as well as in cells and tissues. Cleavage of target RNAs with siNA molecules can be used to inhibit gene expression and define the role of specified gene products in the progression of disease or infection. In this manner, other genetic targets can be defined as important mediators of the disease. These experiments will lead to better treatment of the disease progression by affording the possibility of combination therapies (e.g., multiple siNA molecules targeted to different genes, siNA molecules coupled with known small molecule inhibitors, or intermittent treatment with combinations siNA molecules and/or other chemical or biological molecules). Other in vitro uses of siNA molecules of this invention are well known in the art, and include detection of the presence of mRNAs associated with a disease, infection, or related condition. Such RNA is detected by determining the presence of a cleavage product after treatment with a siNA using standard methodologies, for example, fluorescence resonance emission transfer (FRET).

In a specific example, siNA molecules that cleave only wild-type or mutant forms of the target RNA are used for the assay. The first siNA molecules (i.e., those that cleave only wild-type forms of target RNA) are used to identify wild-type RNA present in the sample and the second siNA molecules (i.e., those that cleave only mutant forms of target RNA) are used to identify mutant RNA in the sample. As reaction controls, synthetic substrates of both wild-type and mutant RNA are cleaved by both siNA molecules to demonstrate the relative siNA efficiencies in the reactions and the absence of cleavage of the "non-targeted" RNA species. The cleavage products from the synthetic substrates also serve to generate size markers for the analysis of wild-type and mutant RNAs in the sample population. Thus, each analysis requires two siNA molecules, two substrates and one unknown sample, which is combined into six reactions. The presence of cleavage products is determined using an RNase protection assay so that full-length and cleavage fragments of each RNA can be analyzed in one lane of a polyacrylamide gel. It is not absolutely required to quantify the results to gain insight into the expression of mutant RNAs and putative risk of the desired phenotypic changes in target cells. The expression of mRNA whose protein product is implicated in the development of the phenotype (i.e., disease related or infection related) is adequate to establish risk. If probes of comparable specific activity are used for both transcripts, then a qualitative comparison of RNA levels is adequate and decreases the cost of the initial diagnosis. Higher mutant form to wild-type ratios are correlated with higher risk whether RNA levels are compared qualitatively or quantitatively.

All patents and publications mentioned in the specification are indicative of the levels of skill of those skilled in the art to which the invention pertains. All references cited in this disclosure are incorporated by reference to the same extent as if each reference had been incorporated by reference in its entirety individually.

One skilled in the art would readily appreciate that the present invention is well adapted to carry out the objects and obtain the ends and advantages mentioned, as well as those inherent therein. The methods and compositions described herein as presently representative of preferred embodiments are exemplary and are not intended as limitations on the scope of the invention. Changes therein and other uses will occur to those skilled in the art, which are encompassed within the spirit of the invention, are defined by the scope of the claims.

It will be readily apparent to one skilled in the art that varying substitutions and modifications can be made to the invention disclosed herein without departing from the scope and spirit of the invention. Thus, such additional embodiments are within the scope of the present invention and the following claims. The present invention teaches one skilled in the art to test various combinations and/or substitutions of chemical modifications described herein toward generating nucleic acid constructs with improved activity for mediating RNAi activity. Such improved activity can comprise improved stability, improved bioavailability, and/or improved activation of cellular responses mediating RNAi. Therefore, the specific embodiments described herein are not limiting and one skilled in the art can readily appreciate that specific combinations of the modifications described herein can be tested without undue experimentation toward identifying siNA molecules with improved RNAi activity.

The invention illustratively described herein suitably can be practiced in the absence of any element or elements, limitation or limitations that are not specifically disclosed herein. The terms and expressions which have been employed are used as terms of description and not of limitation, and there is no intention that in the use of such terms and expressions of excluding any equivalents of the features shown and described or portions thereof, but it is recognized that various modifications are possible within the scope of the invention claimed. Thus, it should be understood that although the present invention has been specifically disclosed by preferred embodiments, optional features, modification and variation of the concepts herein disclosed may be resorted to by those skilled in the art, and that such modifications and variations are considered to be within the scope of this invention as defined by the description and the appended claims.

In addition, where features or aspects of the invention are described in terms of Markush groups or other grouping of alternatives, those skilled in the art will recognize that the invention is also thereby described in terms of any individual member or subgroup of members of the Markush group or other group.

TABLE I

HCV Accession Numbers

| Seq Name | Acc# | LOCUS |
| --- | --- | --- |
| gi\|329763\|gb\|M84754.1\|HPCGENANTI | M84754.1 | HPCGENANTI |
| gi\|567059\|gb\|U16362.1\|HCU16362 | U16362.1 | HCU16362 |
| gi\|5918956\|gb\|AF165059.1\|AF165059 | AF165059.1 | AF165059 |
| gi\|385583\|gb\|S62220.1\|S62220 | S62220.1 | S62220 |
| gi\|6010587\|gb\|AF177040.1\|AF177040 | AF177040.1 | AF177040 |
| gi\|5748510\|emb\|AJ238800.1\|HCJ238800 | AJ238800.1 | HCJ238800 |
| gi\|7650221\|gb\|AF207752.1\|AF207752 | AF207752.1 | AF207752 |
| gi\|11559454\|dbj\|AB049094.1\|AB049094 | AB049094.1 | AB049094 |
| gi\|3550760\|dbj\|D84263.1\|D84263 | D84263.1 | D84263 |
| gi\|221610\|dbj\|D90208.1\|HPCJCG | D90208.1 | HPCJCG |
| gi\|558520\|dbj\|D28917.1\|HPCK3A | D28917.1 | HPCK3A |
| gi\|2176577\|dbj\|E08461.1\|E08461 | E08461.1 | E08461 |
| gi\|6707285\|gb\|AF169005.1\|AF169005 | AF169005.1 | AF169005 |
| gi\|12309923\|emb\|AX057094.1\|AX057094 | AX057094.1 | AX057094 |
| gi\|6010585\|gb\|AF177039.1\|AF177039 | AF177039.1 | AF177039 |
| gi\|7329202\|gb\|AF238482.1\|AF238482 | AF238482.1 | AF238482 |
| gi\|11559464\|dbj\|AB049099.1\|AB049099 | AB049099.1 | AB049099 |
| gi\|5918932\|gb\|AF165047.1\|AF165047 | AF165047.1 | AF165047 |
| gi\|5918946\|gb\|AF165054.1\|AF165054 | AF165054.1 | AF165054 |
| gi\|7650233\|gb\|AF207758.1\|AF207758 | AF207758.1 | AF207758 |
| gi\|19568932\|gb\|AF483269.1\| | AF483269.1 | |
| gi\|7650247\|gb\|AF207765.1\|AF207765 | AF207765.1 | AF207765 |
| gi\|12309919\|emb\|AX057086.1\|AX057086 | AX057086.1 | AX057086 |
| gi\|5708597\|dbj\|E10839.1\|E10839 | E10839.1 | E10839 |
| gi\|2327074\|gb\|AF011753.1\|AF011753 | AF011753.1 | AF011753 |

TABLE I-continued

HCV Accession Numbers

| Seq Name | Acc# | LOCUS |
|---|---|---|
| gi\|12310062\|emb\|AX057317.1\|AX057317 | AX057317.1 | AX057317 |
| gi\|221606\|dbj\|D10750.1\|HPCJ491 | D10750.1 | HPCJ491 |
| gi\|2174448\|dbj\|E06261.1\|E06261 | E06261.1 | E06261 |
| gi\|3098640\|gb\|AF054251.1\|AF054251 | AF054251.1 | AF054251 |
| gi\|18027684\|gb\|AF313916.1\|AF313916 | AF313916.1 | AF313916 |
| gi\|329873\|gb\|M62321.1\|HPCPLYPRE | M62321.1 | HPCPLYPRE |
| gi\|464177\|dbj\|D14853.1\|HPCCGS | D14853.1 | HPCCGS |
| gi\|15422182\|gb\|AY051292.1\| | AY051292.1 | |
| gi\|676877\|dbj\|D49374.1\|HPCFG | D49374.1 | HPCFG |
| gi\|1030706\|dbj\|D50480.1\|HPCK1R1 | D50480.1 | HPCK1R1 |
| gi\|7650223\|gb\|AF207753.1\|AF207753 | AF207753.1 | AF207753 |
| gi\|7650237\|gb\|AF207760.1\|AF207760 | AF207760.1 | AF207760 |
| gi\|11559444\|dbj\|AB049089.1\|AB049089 | AB049089.1 | AB049089 |
| gi\|3550762\|dbj\|D84264.1\|D84264 | D84264.1 | D84264 |
| gi\|12831192\|gb\|AF333324.1\|AF333324 | AF333324.1 | AF333324 |
| gi\|13122265\|dbj\|AB047641.1\|AB047641 | AB047641.1 | AB047641 |
| gi\|7329204\|gb\|AF238483.1\|AF238483 | AF238483.1 | AF238483 |
| gi\|11559468\|dbj\|AB049101.1\|AB049101 | AB049101.1 | AB049101 |
| gi\|5918934\|gb\|AF165048.1\|AF165048 | AF165048.1 | AF165048 |
| gi\|5918948\|gb\|AF165055.1\|AF165055 | AF165055.1 | AF165055 |
| gi\|7650235\|gb\|AF207759.1\|AF207759 | AF207759.1 | AF207759 |
| gi\|7650249\|gb\|AF207766.1\|AF207766 | AF207766.1 | AF207766 |
| gi\|9843676\|emb\|AJ278830.1\|HEC278830 | AJ278830.1 | HEC278830 |
| gi\|11559450\|dbj\|AB049092.1\|AB049092 | AB049092.1 | AB049092 |
| gi\|2943783\|dbj\|D89815.1\|D89815 | D89815.1 | D89815 |
| gi\|9626438\|ref\|NC_001433.1\| | NC_001433.1 | |
| gi\|12310134\|emb\|AX057395.1\|AX057395 | AX057395.1 | AX057395 |
| gi\|11559460\|dbj\|AB049097.1\|AB049097 | AB049097.1 | AB049097 |
| gi\|12309922\|emb\|AX057092.1\|AX057092 | AX057092.1 | AX057092 |
| gi\|2174644\|dbj\|E06457.1\|E06457 | E06457.1 | E06457 |
| gi\|2176559\|dbj\|E08443.1\|E08443 | E08443.1 | E08443 |
| gi\|5918960\|gb\|AF165061.1\|AF165061 | AF165061.1 | AF165061 |
| gi\|2326454\|emb\|Y12083.1\|HCV12083 | Y12083.1 | HCV12083 |
| gi\|5918938\|gb\|AF165050.1\|AF165050 | AF165050.1 | AF165050 |
| gi\|7650225\|gb\|AF207754.1\|AF207754 | AF207754.1 | AF207754 |
| gi\|7650261\|gb\|AF207772.1\|AF207772 | AF207772.1 | AF207772 |
| gi\|1030704\|dbj\|D50485.1\|HPCK1S2 | D50485.1 | HPCK1S2 |
| gi\|3550758\|dbj\|D84262.1\|D84262 | D84262.1 | D84262 |
| gi\|7650239\|gb\|AF207761.1\|AF207761 | AF207761.1 | AF207761 |
| gi\|3550764\|dbj\|D84265.1\|D84265 | D84265.1 | D84265 |
| gi\|7329206\|gb\|AF238484.1\|AF238484 | AF238484.1 | AF238484 |
| gi\|2176516\|dbj\|E08399.1\|E08399 | E08399.1 | E08399 |
| gi\|5918936\|gb\|AF165049.1\|AF165049 | AF165049.1 | AF165049 |
| gi\|11559446\|dbj\|AB049090.1\|AB049090 | AB049090.1 | AB049090 |
| gi\|5441837\|emb\|AJ242653.1\|SSE242653 | AJ242653.1 | SSE242653 |
| gi\|3098641\|gb\|AF054252.1\|AF054252 | AF054252.1 | AF054252 |
| gi\|4753720\|emb\|AJ132997.1\|HCV132997 | AJ132997.1 | HCV132997 |
| gi\|5420376\|emb\|AJ238799.1\|HCJ238799 | AJ238799.1 | HCJ238799 |
| gi\|11559440\|dbj\|AB049087.1\|AB049087 | AB049087.1 | AB049087 |
| gi\|15529110\|gb\|AY045702.1\| | AY045702.1 | |
| gi\|560788\|dbj\|D30613.1\|HPCPP | D30613.1 | HPCPP |
| gi\|11225869\|emb\|AX036253.1\|AX036253 | AX036253.1 | AX036253 |
| gi\|11559456\|dbj\|AB049095.1\|AB049095 | AB049095.1 | AB049095 |
| gi\|329770\|gb\|M58335.1\|HPCHUMR | M58335.1 | HPCHUMR |
| gi\|6707279\|gb\|AF169002.1\|AF169002 | AF169002.1 | AF169002 |
| gi\|221586\|dbj\|D10749.1\|HPCHCJ1 | D10749.1 | HPCHCJ1 |
| gi\|2171981\|dbj\|E03766.1\|E03766 | E03766.1 | E03766 |
| gi\|6010579\|gb\|AF177036.1\|AF177036 | AF177036.1 | AF177036 |
| gi\|1030703\|dbj\|D50484.1\|HPCK1S3 | D50484.1 | HPCK1S3 |
| gi\|3098650\|gb\|AF054257.1\|AF054257 | AF054257.1 | AF054257 |
| gi\|5821154\|dbj\|AB016785.1\|AB016785 | AB016785.1 | AB016785 |
| gi\|5918962\|gb\|AF165062.1\|AF165062 | AF165062.1 | AF165062 |
| gi\|7650227\|gb\|AF207755.1\|AF207755 | AF207755.1 | AF207755 |
| gi\|7650263\|gb\|AF207773.1\|AF207773 | AF207773.1 | AF207773 |
| gi\|1183030\|dbj\|D63822.1\|HPCJK046E2 | D63822.1 | HPCJK046E2 |
| gi\|13122271\|dbj\|AB047644.1\|AB047644 | AB047644.1 | AB047644 |
| gi\|2443428\|gb\|U89019.1\|HCU89019 | U89019.1 | HCU89019 |
| gi\|2462303\|emb\|Y13184.1\|HCV1480 | Y13184.1 | HCV1480 |
| gi\|7329208\|gb\|AF238485.1\|AF238485 | AF238485.1 | AF238485 |
| gi\|1160327\|dbj\|D14484.1\|HPCJRNA | D14484.1 | HPCJRNA |
| gi\|12309921\|emb\|AX057090.1\|AX057090 | AX057090.1 | AX057090 |
| gi\|3098643\|gb\|AF054253.1\|AF054253 | AF054253.1 | AF054253 |
| gi\|21397075\|gb\|AF511948.1\|\| | AF511948.1 | |
| gi\|1030701\|dbj\|D50482.1\|HPCK1R3 | D50482.1 | HPCK1R3 |
| gi\|1030702\|dbj\|D50483.1\|HPCK1S1 | D50483.1 | HPCK1S1 |
| gi\|3098632\|gb\|AF054247.1\|AF054247 | AF054247.1 | AF054247 |

TABLE I-continued

HCV Accession Numbers

| Seq Name | Acc# | LOCUS |
|---|---|---|
| gi\|59478\|emb\|X61596.1\|HCVJK1G | X61596.1 | HCVJK1G |
| gi\|3098652\|gb\|AF054258.1\|AF054258 | AF054258.1 | AF054258 |
| gi\|5918950\|gb\|AF165056.1\|AF165056 | AF165056.1 | AF165056 |
| gi\|7650251\|gb\|AF207767.1\|AF207767 | AF207767.1 | AF207767 |
| gi\|5918964\|gb\|AF165063.1\|AF165063 | AF165063.1 | AF165063 |
| gi\|5918928\|gb\|AF165045.1\|AF165045 | AF165045.1 | AF165045 |
| gi\|5532421\|gb\|AF139594.1\|AF139594 | AF139594.1 | AF139594 |
| gi\|13122267\|dbj\|AB047642.1\|AB047642 | AB047642.1 | AB047642 |
| gi\|5441831\|emb\|AJ242651.1\|SSE242651 | AJ242651.1 | SSE242651 |
| gi\|7650265\|gb\|AF207774.1\|AF207774 | AF207774.1 | AF207774 |
| gi\|7650229\|gb\|AF207756.1\|AF207756 | AF207756.1 | AF207756 |
| gi\|1183032\|dbj\|D63821.1\|HPCJK049E1 | D63821.1 | HPCJK049E1 |
| gi\|2175714\|dbj\|E07579.1\|E07579 | E07579.1 | E07579 |
| gi\|1212741\|dbj\|D45172.1\|HPCHCPO | D45172.1 | HPCHCPO |
| gi\|5708511\|dbj\|E05027.1\|E05027 | E05027.1 | E05027 |
| gi\|1483141\|dbj\|D50409.1\|D50409 | D50409.1 | D50409 |
| gi\|13122261\|dbj\|AB047639.1\|AB047639 | AB047639.1 | AB047639 |
| gi\|6521008\|dbj\|AB031663.1\|AB031663 | AB031663.1 | AB031663 |
| gi\|633201\|emb\|X76918.1\|HCVCENS1 | X76918.1 | HCVCENS1 |
| gi\|329737\|gb\|M67463.1\|HPCCGAA | M67463.1 | HPCCGAA |
| gi\|11559452\|dbj\|AB049093.1\|AB049093 | AB049093.1 | AB049093 |
| gi\|13619567\|emb\|AX100563.1\|AX100563 | AX100563.1 | AX100563 |
| gi\|221604\|dbj\|D13558.1\|HPCJ483 | D13558.1 | HPCJ483 |
| gi\|11225872\|emb\|AX036256.1\|AX036256 | AX036256.1 | AX036256 |
| gi\|1749761\|dbj\|D89872.1\|D89872 | D89872.1 | D89872 |
| gi\|5918940\|gb\|AF165051.1\|AF165051 | AF165051.1 | AF165051 |
| gi\|4753718\|emb\|AJ132996.1\|HCV132996 | AJ132996.1 | HCV132996 |
| gi\|7650241\|gb\|AF207762.1\|AF207762 | AF207762.1 | AF207762 |
| gi\|3098645\|gb\|AF054254.1\|AF054254 | AF054254.1 | AF054254 |
| gi\|9930556\|gb\|AF290978.1\|AF290978 | AF290978.1 | AF290978 |
| gi\|11559462\|dbj\|AB049098.1\|AB049098 | AB049098.1 | AB049098 |
| gi\|2764397\|emb\|AJ000009.1\|HCVPOLYP | AJ000009.1 | HCVPOLYP |
| gi\|221608\|dbj\|D10988.1\|HPCJ8G | D10988.1 | HPCJ8G |
| gi\|3098634\|gb\|AF054248.1\|AF054248 | AF054248.1 | AF054248 |
| gi\|221650\|dbj\|D00944.1\|HPCPOLP | D00944.1 | HPCPOLP |
| gi\|306286\|gb\|M96362.1\|HPCUNKCDS | M96362.1 | HPCUNKCDS |
| gi\|3098654\|gb\|AF054259.1\|AF054259 | AF054259.1 | AF054259 |
| gi\|5918952\|gb\|AF165057.1\|AF165057 | AF165057.1 | AF165057 |
| gi\|7650253\|gb\|AF207768.1\|AF207768 | AF207768.1 | AF207768 |
| gi\|5918966\|gb\|AF165064.1\|AF165064 | AF165064.1 | AF165064 |
| gi\|15487693\|gb\|AF356827.1\|AF356827 | AF356827.1 | AF356827 |
| gi\|5738246\|gb\|AF176573.1\|AF176573 | AF176573.1 | AF176573 |
| gi\|11559448\|dbj\|AB049091.1\|AB049091 | AB049091.1 | AB049091 |
| gi\|21397077\|gb\|AF511950.1\| | AF511950.1 | |
| gi\|3098638\|gb\|AF054250.1\|AF054250 | AF054250.1 | AF054250 |
| gi\|6707281\|gb\|AF169003.1\|AF169003 | AF169003.1 | AF169003 |
| gi\|329739\|gb\|L02836.1\|HPCCGENOM | L02836.1 | HPCCGENOM |
| gi\|6010581\|gb\|AF177037.1\|AF177037 | AF177037.1 | AF177037 |
| gi\|11559442\|dbj\|AB049088.1\|AB049088 | AB049088.1 | AB049088 |
| gi\|21397076\|gb\|AF511949.1\| | AF511949.1 | |
| gi\|1030705\|dbj\|D50481.1\|HPCK1R2 | D50481.1 | HPCK1R2 |
| gi\|2176384\|dbj\|E08264.1\|E08264 | E08264.1 | E08264 |
| gi\|3660725\|gb\|AF064490.1\|AF064490 | AF064490.1 | AF064490 |
| gi\|2252489\|emb\|Y11604.1\|HCV4APOLY | Y11604.1 | HCV4APOLY |
| gi\|5918942\|gb\|AF165052.1\|AF165052 | AF165052.1 | AF165052 |
| gi\|2895898\|gb\|AF046866.1\|AF046866 | AF046866.1 | AF046866 |
| gi\|7650243\|gb\|AF207763.1\|AF207763 | AF207763.1 | AF207763 |
| gi\|11559458\|dbj\|AB049096.1\|AB049096 | AB049096.1 | AB049096 |
| gi\|13122263\|dbj\|AB047640.1\|AB047640 | AB047640.1 | AB047640 |
| gi\|5708574\|dbj\|E08263.1\|E08263 | E08263.1 | E08263 |
| gi\|7650257\|gb\|AF207770.1\|AF207770 | AF207770.1 | AF207770 |
| gi\|3098647\|gb\|AF054255.1\|AF054255 | AF054255.1 | AF054255 |
| gi\|11559466\|dbj\|AB049100.1\|AB049100 | AB049100.1 | AB049100 |
| gi\|1181831\|gb\|U45476.1\|HCU45476 | U45476.1 | HCU45476 |
| gi\|2327070\|gb\|AF011751.1\|AF011751 | AF011751.1 | AF011751 |
| gi\|3098636\|gb\|AF054249.1\|AF054249 | AF054249.1 | AF054249 |
| gi\|7329210\|gb\|AF238486.1\|AF238486 | AF238486.1 | AF238486 |
| gi\|221612\|dbj\|D11168.1\|HPCJTA | D11168.1 | HPCJTA |
| gi\|960359\|dbj\|D63857.1\|HPVHCVN | D63857.1 | HPVHCVN |
| gi\|13122273\|dbj\|AB047645.1\|AB047645 | AB047645.1 | AB047645 |
| gi\|5918954\|gb\|AF165058.1\|AF165058 | AF165058.1 | AF165058 |
| gi\|7650255\|gb\|AF207769.1\|AF207769 | AF207769.1 | AF207769 |
| gi\|437107\|gb\|U01214.1\|HCU01214 | U01214.1 | HCU01214 |
| gi\|471116\|dbj\|D10934.1\|HPCRNA | D10934.1 | HPCRNA |
| gi\|13026028\|dbj\|E66593.1\|E66593 | E66593.1 | E66593 |
| gi\|2316097\|gb\|AF009606.1\|AF009606 | AF009606.1 | AF009606 |

TABLE I-continued

HCV Accession Numbers

| Seq Name | Acc# | LOCUS |
|---|---|---|
| gi\|6707283\|gb\|AF169004.1\|AF169004 | AF169004.1 | AF169004 |
| gi\|514395\|dbj\|D17763.1\|HPCEGS | D17763.1 | HPCEGS |
| gi\|9757541\|dbj\|AB030907.1\|AB030907 | AB030907.1 | AB030907 |
| gi\|7329200\|gb\|AF238481.1\|AF238481 | AF238481.1 | AF238481 |
| gi\|6010583\|gb\|AF177038.1\|AF177038 | AF177038.1 | AF177038 |
| gi\|2172621\|dbj\|E04420.1\|E04420 | E04420.1 | E04420 |
| gi\|8926244\|gb\|AF271632.1\|AF271632 | AF271632.1 | AF271632 |
| gi\|5918930\|gb\|AF165046.1\|AF165046 | AF165046.1 | AF165046 |
| gi\|7650231\|gb\|AF207757.1\|AF207757 | AF207757.1 | AF207757 |
| gi\|5918944\|gb\|AF165053.1\|AF165053 | AF165053.1 | AF165053 |
| gi\|7650245\|gb\|AF207764.1\|AF207764 | AF207764.1 | AF207764 |
| gi\|12309920\|emb\|AX057088.1\|AX057088 | AX057088.1 | AX057088 |
| gi\|5918958\|gb\|AF165060.1\|AF165060 | AF165060.1 | AF165060 |
| gi\|7650259\|gb\|AF207771.1\|AF207771 | AF207771.1 | AF207771 |
| gi\|7341102\|gb\|AF208024.1\|AF208024 | AF208024.1 | AF208024 |
| gi\|3098649\|gb\|AF054256.1\|AF054256 | AF054256.1 | AF054256 |
| gi\|1944375\|dbj\|D85516.1\|D85516 | D85516.1 | D85516 |
| gi\|2327072\|gb\|AF011752.1\|AF011752 | AF011752.1 | AF011752 |
| gi\|221614\|dbj\|D11355.1\|HPCJTB | D11355.1 | HPCJTB |
| gi\|13122269\|dbj\|AB047643.1\|AB047643 | AB047643.1 | AB047643 |

TABLE II

HCV siNA AND TARGET SEQUENCES

| Sequence | Seq ID | Upper seq | Seq ID | Lower seq | Seq ID |
|---|---|---|---|---|---|
| GCCCCGGGAGGUCUCGUAG | 1 | GCCCCGGGAGGUCUCGUAG | 1 | CUACGAGACCUCCCGGGGC | 697 |
| UGUGGUACUGCCUGAUAGG | 2 | UGUGGUACUGCCUGAUAGG | 2 | CCUAUCAGGCAGUACCACA | 698 |
| UUGUGGUACUGCCUGAUAG | 3 | UUGUGGUACUGCCUGAUAG | 3 | CUAUCAGGCAGUACCACAA | 699 |
| CCCCGGGAGGUCUCGUAGA | 4 | CCCCGGGAGGUCUCGUAGA | 4 | UCUACGAGACCUCCCGGGG | 700 |
| GUGGUACUGCCUGAUAGGG | 5 | GUGGUACUGCCUGAUAGGG | 5 | CCCUAUCAGGCAGUACCAC | 701 |
| CUGCCUGAUAGGGUGCUUG | 6 | CUGCCUGAUAGGGUGCUUG | 6 | CAAGCACCCUAUCAGGCAG | 702 |
| CCUUGUGGUACUGCCUGAU | 7 | CCUUGUGGUACUGCCUGAU | 7 | AUCAGGCAGUACCACAAGG | 703 |
| GCGAAAGGCCUUGUGGUAC | 8 | GCGAAAGGCCUUGUGGUAC | 8 | GUACCACAAGGCCUUUCGC | 704 |
| UACUGCCUGAUAGGGUGCU | 9 | UACUGCCUGAUAGGGUGCU | 9 | AGCACCCUAUCAGGCAGUA | 705 |
| GGUACUGCCUGAUAGGGUG | 10 | GGUACUGCCUGAUAGGGUG | 10 | CACCCUAUCAGGCAGUACC | 706 |
| AAAGGCCUUGUGGUACUGC | 11 | AAAGGCCUUGUGGUACUGC | 11 | GCAGUACCACAAGGCCUUU | 707 |
| AAGGCCUUGUGGUACUGCC | 12 | AAGGCCUUGUGGUACUGCC | 12 | GGCAGUACCACAAGGCCUU | 708 |
| CUUGUGGUACUGCCUGAUA | 13 | CUUGUGGUACUGCCUGAUA | 13 | UAUCAGGCAGUACCACAAG | 709 |
| AGGCCUUGUGGUACUGCCU | 14 | AGGCCUUGUGGUACUGCCU | 14 | AGGCAGUACCACAAGGCCU | 710 |
| GUACUGCCUGAUAGGGUGC | 15 | GUACUGCCUGAUAGGGUGC | 15 | GCACCCUAUCAGGCAGUAC | 711 |
| ACUGCCUGAUAGGGUGCUU | 16 | ACUGCCUGAUAGGGUGCUU | 16 | AAGCACCCUAUCAGGCAGU | 712 |
| CUUGCGAGUGCCCCGGGAG | 17 | CUUGCGAGUGCCCCGGGAG | 17 | CUCCCGGGGCACUCGCAAG | 713 |
| CUGAUAGGGUGCUUGCGAG | 18 | CUGAUAGGGUGCUUGCGAG | 18 | CUCGCAAGCACCCUAUCAG | 714 |
| UUGCGAGUGCCCCGGGAGG | 19 | UUGCGAGUGCCCCGGGAGG | 19 | CCUCCCGGGGCACUCGCAA | 715 |
| CCUGAUAGGGUGCUUGCGA | 20 | CCUGAUAGGGUGCUUGCGA | 20 | UCGCAAGCACCCUAUCAGG | 716 |
| GGCCUUGUGGUACUGCCUG | 21 | GGCCUUGUGGUACUGCCUG | 21 | CAGGCAGUACCACAAGGCC | 717 |
| GCUUGCGAGUGCCCCGGGA | 22 | GCUUGCGAGUGCCCCGGGA | 22 | UCCCGGGGCACUCGCAAGC | 718 |
| UGCCUGAUAGGGUGCUUGC | 23 | UGCCUGAUAGGGUGCUUGC | 23 | GCAAGCACCCUAUCAGGCA | 719 |

TABLE II-continued

HCV siNA AND TARGET SEQUENCES

| Sequence | Seq ID | Upper seq | Seq ID | Lower seq | Seq ID |
|---|---|---|---|---|---|
| GAAAGGCCUUGUGGUACUG | 24 | GAAAGGCCUUGUGGUACUG | 24 | CAGUACCACAAGGCCUUUC | 720 |
| GCCUGAUAGGGUGCUUGCG | 25 | GCCUGAUAGGGUGCUUGCG | 25 | CGCAAGCACCCUAUCAGGC | 721 |
| CGAAAGGCCUUGUGGUACU | 26 | CGAAAGGCCUUGUGGUACU | 26 | AGUACCACAAGGCCUUUCG | 722 |
| GCCUUGUGGUACUGCCUGA | 27 | GCCUUGUGGUACUGCCUGA | 27 | UCAGGCAGUACCACAAGGC | 723 |
| GAGUGCCCCGGGAGGUCUC | 28 | GAGUGCCCCGGGAGGUCUC | 28 | GAGACCUCCCGGGGCACUC | 724 |
| CCCGGGAGGUCUCGUAGAC | 29 | CCCGGGAGGUCUCGUAGAC | 29 | GUCUACGAGACCUCCCGGG | 725 |
| UGCGAGUGCCCCGGGAGGU | 30 | UGCGAGUGCCCCGGGAGGU | 30 | ACCUCCCGGGGCACUCGCA | 726 |
| UGGUACUGCCUGAUAGGGU | 31 | UGGUACUGCCUGAUAGGGU | 31 | ACCCUAUCAGGCAGUACCA | 727 |
| CCGGUGAGUACACCGGAAU | 32 | CCGGUGAGUACACCGGAAU | 32 | AUUCCGGUGUACUCACCGG | 728 |
| GCGAGUGCCCCGGGAGGUC | 33 | GCGAGUGCCCCGGGAGGUC | 33 | GACCUCCCGGGGCACUCGC | 729 |
| CGAGUGCCCCGGGAGGUCU | 34 | CGAGUGCCCCGGGAGGUCU | 34 | AGACCUCCCGGGGCACUCG | 730 |
| UGCCCCGGGAGGUCUCGUA | 35 | UGCCCCGGGAGGUCUCGUA | 35 | UACGAGACCUCCCGGGGCA | 731 |
| GUGCCCCGGGAGGUCUCGU | 36 | GUGCCCCGGGAGGUCUCGU | 36 | ACGAGACCUCCCGGGGCAC | 732 |
| AGUGCCCCGGGAGGUCUCG | 37 | AGUGCCCCGGGAGGUCUCG | 37 | CGAGACCUCCCGGGGCACU | 733 |
| CCGGGAGGUCUCGUAGACC | 38 | CCGGGAGGUCUCGUAGACC | 38 | GGUCUACGAGACCUCCCGG | 734 |
| UGAUAGGGUGCUUGCGAGU | 39 | UGAUAGGGUGCUUGCGAGU | 39 | ACUCGCAAGCACCCUAUCA | 735 |
| GUGCUUGCGAGUGCCCCGG | 40 | GUGCUUGCGAGUGCCCCGG | 40 | CCGGGGCACUCGCAAGCAC | 736 |
| AUAGGGUGCUUGCGAGUGC | 41 | AUAGGGUGCUUGCGAGUGC | 41 | GCACUCGCAAGCACCCUAU | 737 |
| GGGUGCUUGCGAGUGCCCC | 42 | GGGUGCUUGCGAGUGCCCC | 42 | GGGGCACUCGCAAGCACCC | 738 |
| CGGGAGGUCUCGUAGACCG | 43 | CGGGAGGUCUCGUAGACCG | 43 | CGGUCUACGAGACCUCCCG | 739 |
| GGGAGGUCUCGUAGACCGU | 44 | GGGAGGUCUCGUAGACCGU | 44 | ACGGUCUACGAGACCUCCC | 740 |
| GAUAGGGUGCUUGCGAGUG | 45 | GAUAGGGUGCUUGCGAGUG | 45 | CACUCGCAAGCACCCUAUC | 741 |
| GGAGGUCUCGUAGACGUG | 46 | GGAGGUCUCGUAGACCGUG | 46 | CACGGUCUACGAGACCUCC | 742 |
| AGGGUGCUUGCGAGUGCCC | 47 | AGGGUGCUUGCGAGUGCCC | 47 | GGGCACUCGCAAGCACCCU | 743 |
| UGCUUGCGAGUGCCCCGGG | 48 | UGCUUGCGAGUGCCCCGGG | 48 | CCCGGGGCACUCGCAAGCA | 744 |
| GGUGCUUGCGAGUGCCCCG | 49 | GGUGCUUGCGAGUGCCCCG | 49 | CGGGGCACUCGCAAGCACC | 745 |
| UAGGGUGCUUGCGAGUGCC | 50 | UAGGGUGCUUGCGAGUGCC | 50 | GGCACUCGCAAGCACCCUA | 746 |
| AGGUCUCGUAGACCGUGCA | 51 | AGGUCUGGUAGACCGUGCA | 51 | UGCACGGUCUACGAGACCU | 747 |
| GAGGUCUCGUAGACCGUGC | 52 | GAGGUCUCGUAGACCGUGC | 52 | GCACGGUCUACGAGACCUC | 748 |
| GGAACCGGUGAGUACACCG | 53 | GGAACCGGUGAGUACACCG | 53 | CGGUGUACUCACCGGUUCC | 749 |
| CGGAACCGGUGAGUACACC | 54 | CGGAACCGGUGAGUACACC | 54 | GGUGUACUCACCGGUUCCG | 750 |
| CGGUGAGUACACCGGAAUU | 55 | CGGUGAGUACACCGGAAUU | 55 | AAUUCCGGUGUACUCACCG | 751 |
| GCGGAACCGGUGAGUACAC | 56 | GCGGAACCGGUGAGUACAC | 56 | GUGUACUCACCGGUUCCGC | 752 |
| AACCGGUGAGUACACCGGA | 57 | AACCGGUGAGUACACCGGA | 57 | UCCGGUGUACUCACCGGUU | 753 |
| ACCGGUGAGUACACCGGAA | 58 | ACCGGUGAGUACACCGGAA | 58 | UUCCGGUGUACUCACCGGU | 754 |
| CUGCGGAACCGGUGAGUAC | 59 | CUGCGGAACCGGUGAGUAC | 59 | GUACUCACCGGUUCCGCAG | 755 |
| GUCUGCGGAACCGGUGAGU | 60 | GUCUGCGGAACCGGUGAGU | 60 | ACUCACCGGUUCCGCAGAC | 756 |

TABLE II-continued

HCV siNA AND TARGET SEQUENCES

| Sequence | Seq ID | Upper seq | Seq ID | Lower seq | Seq ID |
|---|---|---|---|---|---|
| GAACCGGUGAGUACACCGG | 61 | GAACCGGUGAGUACACCGG | 61 | CCGGUGUACUCACCGGUUC | 757 |
| UGCGGAACCGGUGAGUACA | 62 | UGCGGAACCGGUGAGUACA | 62 | UGUACUCACCGGUUCCGCA | 758 |
| UCUGCGGAACCGGUGAGUA | 63 | UCUGCGGAACCGGUGAGUA | 63 | UACUCACCGGUUCCGCAGA | 759 |
| GGGAGAGCCAUAGUGGUCU | 64 | GGGAGAGCCAUAGUGGUCU | 64 | AGACCACUAUGGCUCUCCC | 760 |
| GUGGUCUGCGGAACCGGUG | 65 | GUGGUCUGCGGAACCGGUG | 65 | CACCGGUUCCGCAGACCAC | 761 |
| GGUCUGCGGAACCGGUGAG | 66 | GGUCUGCGGAACCGGUGAG | 66 | CUCACCGGUUCCGCAGACC | 762 |
| CGGGAGAGCCAUAGUGGUC | 67 | CGGGAGAGCCAUAGUGGUC | 67 | GACCACUAUGGCUCUCCCG | 763 |
| CCGGGAGAGCCAUAGUGGU | 68 | CCGGGAGAGCCAUAGUGGU | 68 | ACCACUAUGGCUCUCCCGG | 764 |
| UGGUCUGCGGAACCGGUGA | 69 | UGGUCUGCGGAACCGGUGA | 69 | UCACCGGUUCCGCAGACCA | 765 |
| GUGAGUACACCGGAAUUGC | 70 | GUGAGUACACCGGAAUUGC | 70 | GCAAUUCCGGUGUACUCAC | 766 |
| UGAGUACACCGGAAUUGCC | 71 | UGAGUACACCGGAAUUGCC | 71 | GGCAAUUCCGGUGUACUCA | 767 |
| GGUGAGUACACCGGAAUUG | 72 | GGUGAGUACACCGGAAUUG | 72 | CAAUUCCGGUGUACUCACC | 768 |
| GAGCCAUAGUGGUCUGCGG | 73 | GAGCCAUAGUGGUCUGCGG | 73 | CCGCAGACCACUAUGGCUC | 769 |
| AGAGCCAUAGUGGUCUGCG | 74 | AGAGCCAUAGUGGUCUGCG | 74 | CGCAGACCACUAUGGCUCU | 770 |
| UAGUGGUCUGCGGAACCGG | 75 | UAGUGGUCUGCGGAACCGG | 75 | CCGGUUCCGCAGACCACUA | 771 |
| AUAGUGGUCUGCGGAACCG | 76 | AUAGUGGUCUGCGGAACCG | 76 | CGGUUCCGCAGACCACUAU | 772 |
| GAGAGCCAUAGUGGUCUGC | 77 | GAGAGCCAUAGUGGUCUGC | 77 | GCAGACCACUAUGGCUCUC | 773 |
| GCCAUAGUGGUCUGCGGAA | 78 | GCCAUAGUGGUCUGCGGAA | 78 | UUCCGCAGACCACUAUGGC | 774 |
| AGUGGUCUGCGGAACCGGU | 79 | AGUGGUCUGCGGAACCGGU | 79 | ACCGGUUCCGCAGACCACU | 775 |
| CAUAGUGGUCUGCGGAACC | 80 | CAUAGUGGUCUGCGGAACC | 80 | GGUUCCGCAGACCACUAUG | 776 |
| AGCCAUAGUGGUCUGCGGA | 81 | AGCCAUAGUGGUCUGCGGA | 81 | UCCGCAGACCACUAUGGCU | 777 |
| CCAUAGUGGUCUGCGGAAC | 82 | CCAUAGUGGUCUGCGGAAC | 82 | GUUCCGCAGACCACUAUGG | 778 |
| CCCCUCCCGGGAGAGCCAU | 83 | CCCCUCCCGGGAGAGCCAU | 83 | AUGGCUCUCCCGGGAGGGG | 779 |
| GGAGAGCCAUAGUGGUCUG | 84 | GGAGAGCCAUAGUGGUCUG | 84 | CAGACCACUAUGGCUCUCC | 780 |
| CCCGGGAGAGCCAUAGUGG | 85 | CCCGGGAGAGCCAUAGUGG | 85 | CCACUAUGGCUCUCCCGGG | 781 |
| CCCCCUCCCGGGAGAGCCA | 86 | CCCCCUCCCGGGAGAGCCA | 86 | UGGCUCUCCCGGGAGGGGG | 782 |
| UCCCGGGAGAGCCAUAGUG | 87 | UCCCGGGAGAGCCAUAGUG | 87 | CACUAUGGCUCUCCCGGGA | 783 |
| CCCCCCUCCCGGGAGAGCC | 88 | CCCCCCUCCCGGGAGAGCC | 88 | GGCUCUCCCGGGAGGGGGG | 784 |
| CCCUCCCGGGAGAGCCAUA | 89 | CCCUCCCGGGAGAGCCAUA | 89 | UAUGGCUCUCCCGGGAGGG | 785 |
| CCUCCCGGGAGAGCCAUAG | 90 | CCUCCCGGGAGAGCCAUAG | 90 | CUAUGGCUCUCCCGGGAGG | 786 |
| CUCCCGGGAGAGCCAUAGU | 91 | CUCCCGGGAGAGCCAUAGU | 91 | ACUAUGGCUCUCCCGGGAG | 787 |
| UGUUGCCGCGCAGGGGCCC | 92 | UGUUGCCGCGCAGGGGCCC | 92 | GGGCCCCUGCGCGGCAACA | 788 |
| CCCCCCCUCCCGGGAGAGC | 93 | CCCCCCCUCCCGGGAGAGC | 93 | GCUCUCCCGGGAGGGGGGG | 789 |
| CAUGGCGUUAGUAUGAGUG | 94 | CAUGGCGUUAGUAUGAGUG | 94 | CACUCAUACUAACGCCAUG | 790 |
| UAGCCAUGGCGUUAGUAUG | 95 | UAGCCAUGGCGUUAGUAUG | 95 | CAUACUAACGCCAUGGCUA | 791 |
| AGCCAUGGCGUUAGUAUGA | 96 | AGCCAUGGCGUUAGUAUGA | 96 | UCAUACUAACGCCAUGGCU | 792 |
| CCAUGGCGUUAGUAUGAGU | 97 | CCAUGGCGUUAGUAUGAGU | 97 | ACUCAUACUAACGCCAUGG | 793 |
| AUGGCGUUAGUAUGAGUGU | 98 | AUGGCGUUAGUAUGAGUGU | 98 | ACACUCAUACUAACGCCAU | 794 |

TABLE II-continued

HCV siNA AND TARGET SEQUENCES

| Sequence | Seq ID | Upper seq | Seq ID | Lower seq | Seq ID |
|---|---|---|---|---|---|
| AAGCGUCUACGCAUGGCGU | 99 | AAGCGUCUAGCCAUGGCGU | 99 | ACGCCAUGGCUAGACGCUU | 795 |
| GUCUAGCCAUGGCGUUAGU | 100 | GUCUAGCCAUGGCGUUAGU | 100 | ACUAACGCCAUGGCUAGAC | 796 |
| AAAGCGUCUAGCCAUGGCG | 101 | AAAGCGUCUAGCCAUGGCG | 101 | CGCCAUGGCUAGACGCUUU | 797 |
| GCGUCUAGCCAUGGCGUUA | 102 | GCGUCUAGCCAUGGCGUUA | 102 | UAACGCCAUGGCUAGACGC | 798 |
| GCCAUGGCGUUAGUAUGAG | 103 | GCCAUGGCGUUAGUAUGAG | 103 | CUCAUACUAACGCCAUGGC | 799 |
| AGCGUCUAGCCAUGGCGUU | 104 | AGCGUCUAGCCAUGGCGUU | 104 | AACGCCAUGGCUAGACGCU | 800 |
| CGUCUAGCCAUGGCGUUAG | 105 | CGUCUAGCCAUGGCGUUAG | 105 | CUAACGCCAUGGCUAGACG | 801 |
| UCUAGCCAUGGCGUUAGUA | 106 | UCUAGCCAUGGCGUUAGUA | 106 | UACUAACGCCAUGGCUAGA | 802 |
| GAAAGCGUCUAGCCAUGGC | 107 | GAAAGCGUCUAGCCAUGGC | 107 | GCCAUGGCUAGACGCUUUC | 803 |
| CUAGCCAUGGCGUUAGUAU | 108 | CUAGCCAUGGCGUUAGUAU | 108 | AUACUAACGCCAUGGCUAG | 804 |
| CACUCCCCUGUGAGGAACU | 109 | CACUCCCCUGUGAGGAACU | 109 | AGUUCCUCACAGGGGAGUG | 805 |
| ACCUCAAAGAAAAACCAAA | 110 | ACCUCAAAGAAAAACCAAA | 110 | UUUGGUUUUUCUUUGAGGU | 806 |
| CGCAGAAAGCGUCUAGCCA | 111 | CGCAGAAAGCGUCUAGCCA | 111 | UGGCUAGACGCUUUCUGCG | 807 |
| GGGUAAGGUCAUCGAUACC | 112 | GGGUAAGGUCAUCGAUACC | 112 | GGUAUCGAUGACCUUACCC | 808 |
| CAGAAAGCGUCUAGCCAUG | 113 | CAGAAAGCGUCUAGCCAUG | 113 | CAUGGCUAGACGCUUUCUG | 809 |
| AAACCUCAAAGAAAAACCA | 114 | AAACCUCAAAGAAAAACCA | 114 | UGGUUUUUCUUUGAGGUUU | 810 |
| GCAGAAAGCGUCUAGCCAU | 115 | GCAGAAAGCGUCUAGCCAU | 115 | AUGGCUAGACGCUUUCUGC | 811 |
| AGAAAGCGUCUAGCCAUGG | 116 | AGAAAGCGUCUAGCCAUGG | 116 | CCAUGGCUAGACGCUUUCU | 812 |
| ACGCAGAAAGCGUCUAGCC | 117 | ACGCAGAAAGCGUCUAGCC | 117 | GGCUAGACGCUUUCUGCGU | 813 |
| AACCUCAAAGAAAAACCAA | 118 | AACCUCAAAGAAAAACCAA | 118 | UUGGUUUUUCUUUGAGGUU | 814 |
| UGGGUAAGGUCAUCGAUAC | 119 | UGGGUAAGGUCAUCGAUAC | 119 | GUAUCGAUGACCUUACCCA | 815 |
| GUAAGGUCAUCGAUACCCU | 120 | GUAAGGUCAUCGAUACCCU | 120 | AGGGUAUCGAUGACCUUAC | 816 |
| UUCACGCAGAAAGCGUCUA | 121 | UUCACGCAGAAAGCGUCUA | 121 | UAGACGCUUUCUGCGUGAA | 817 |
| GGUAAGGUCAUCGAUACCC | 122 | GGUAAGGUCAUCGAUACCC | 122 | GGGUAUCGAUGACCUUACC | 818 |
| AUCACUCCCCUGUGAGGAA | 123 | AUCACUCCCCUGUGAGGAA | 123 | UUCCUCACAGGGGAGUGAU | 819 |
| UCACUCCCCUGUGAGGAAC | 124 | UCACUCCCCUGUGAGGAAC | 124 | GUUCCUCACAGGGGAGUGA | 820 |
| UGUCUUCACGCAGAAAGCG | 125 | UGUCUUCACGCAGAAAGCG | 125 | CGCUUUCUGCGUGAAGACA | 821 |
| UCACGCAGAAAGCGUCUAG | 126 | UCACGCAGAAAGCGUCUAG | 126 | CUAGACGCUUUCUGCGUGA | 822 |
| CACGCAGAAAGCGUCUAGC | 127 | CACGCAGAAAGCGUCUAGC | 127 | GCUAGACGCUUUCUGCGUG | 823 |
| GACCGGGUCCUUUCUUGGA | 128 | GACCGGGUCCUUUCUUGGA | 128 | UCCAAGAAAGGACCCGGUC | 824 |
| GAGGAACUACUGUCUUCAC | 129 | GAGGAACUACUGUCUUCAC | 129 | GUGAAGACAGUAGUUCCUC | 825 |
| CUGUGAGGAACUACUGUCU | 130 | CUGUGAGGAACUACUGUCU | 130 | AGACAGUAGUUCCUCACAG | 826 |
| GGAACUACUGUCUUCACGC | 131 | GGAACUACUGUCUUCACGC | 131 | GCGUGAAGACAGUAGUUCC | 827 |
| ACUCCCCUGUGAGGAACUA | 132 | ACUCCCCUGUGAGGAACUA | 132 | UAGUUCCUCACAGGGGAGU | 828 |
| GUCUUCACGCAGAAAGCGU | 133 | GUCUUCACGCAGAAAGCGU | 133 | ACGCUUUCUGCGUGAAGAC | 829 |
| AGGAACUACUGUCUUCACG | 134 | AGGAACUACUGUCUUCACG | 134 | CGUGAAGACAGUAGUUCCU | 830 |
| CCUGUGAGGAACUACUGUC | 135 | CCUGUGAGGAACUACUGUC | 135 | GACAGUAGUUCCUCACAGG | 831 |

TABLE II-continued

HCV siNA AND TARGET SEQUENCES

| Sequence | Seq ID | Upper seq | Seq ID | Lower seq | Seq ID |
|---|---|---|---|---|---|
| UGUGAGGAACUACUGUCUU | 136 | UGUGAGGAACUACUGUCUU | 136 | AAGACAGUAGUUCCUCACA | 832 |
| UCUUCACGCAGAAAGCGUC | 137 | UCUUCACGCAGAAAGCGUC | 137 | GACGCUUUCUGCGUGAAGA | 833 |
| GAACUACUGUCUUCACGCA | 138 | GAACUACUGUCUUCAGGCA | 138 | UGCGUGAAGACAGUAGUUC | 834 |
| CCCUGUGAGGAACUACUGU | 139 | CCCUGUGAGGAACUACUGU | 139 | ACAGUAGUUCCUCACAGGG | 835 |
| CUUCACGCAGAAAGCGUCU | 140 | CUUCACGCAGAAAGCGUCU | 140 | AGACGCUUUCUGCGUGAAG | 836 |
| UGAGGAACUACUGUCUUCA | 141 | UGAGGAACUACUGUCUUCA | 141 | UGAAGACAGUAGUUCCUCA | 837 |
| UGGCGUUAGUAUGAGUGUC | 142 | UGGCGUUAGUAUGAGUGUC | 142 | GACACUCAUACUAACGCCA | 838 |
| CCCCUGUGAGGAACUACUG | 143 | CCCCUGUGAGGAACUACUG | 143 | CAGUAGUUCCUCACAGGGG | 839 |
| GUGAGGAACUACUGUCUUC | 144 | GUGAGGAACUACUGUCUUC | 144 | GAAGACAGUAGUUCCUCAC | 840 |
| GGCGUUAGUAUGAGUGUCG | 145 | GGCGUUAGUAUGAGUGUCG | 145 | CGACACUCAUACUAACGCC | 841 |
| GCCGAGUAGUGUUGGGUCG | 146 | GCCGAGUAGUGUUGGGUCG | 146 | CGACCCAACACUACUCGGC | 842 |
| ACUGUCUUCACGCAGAAAG | 147 | ACUGUCUUCACGCAGAAAG | 147 | CUUUCUGCGUGAAGACAGU | 843 |
| UGGGUCGCGAAAGGCCUUG | 148 | UGGGUCGCGAAAGGCCUUG | 148 | CAAGGCCUUUCGCGACCCA | 844 |
| CUACUGUCUUCACGCAGAA | 149 | CUACUGUCUUCACGCAGAA | 149 | UUCUGCGUGAAGACAGUAG | 845 |
| CGAGUAGUGUUGGGUCGCG | 150 | CGAGUAGUGUUGGGUCGCG | 150 | CGCGACCCAACACUACUCG | 846 |
| GUAGUGUUGGGUCGCGAAA | 151 | GUAGUGUUGGGUCGCGAAA | 151 | UUUCGCGACCCAACACUAC | 847 |
| UAAACCUCAAAGAAAAACC | 152 | UAAACCUCAAAGAAAAACC | 152 | GGUUUUUCUUUGAGGUUUA | 848 |
| CCGAGUAGUGUUGGGUCGC | 153 | CCGAGUAGUGUUGGGUCGC | 153 | GCGACCCAACACUACUCGG | 849 |
| AGCCGAGUAGUGUUGGGUC | 154 | AGCCGAGUAGUGUUGGGUC | 154 | GACCCAACACUACUCGGCU | 850 |
| GUCGCGAAAGGCCUUGUGG | 155 | GUCGCGAAAGGCCUUGUGG | 155 | CCACAAGGCCUUUCGCGAG | 851 |
| UAGUGUUGGGUCGCGAAAG | 156 | UAGUGUUGGGUCGCGAAAG | 156 | CUUUCGCGACCCAACACUA | 852 |
| CUAGCCGAGUAGUGUUGGG | 157 | CUAGCCGAGUAGUGUUGGG | 157 | CCCAACACUACUCGGCUAG | 853 |
| GAGUAGUGUUGGGUCGCGA | 158 | GAGUAGUGUUGGGUCGCGA | 158 | UCGCGACCCAACACUACUC | 854 |
| UCGCGAAAGGCCUUGUGGU | 159 | UCGCGAAAGGCCUUGUGGU | 159 | ACCACAAGGCCUUUCGCGA | 855 |
| GCGUUAGUAUGAGUGUCGU | 160 | GCGUUAGUAUGAGUGUCGU | 160 | ACGACACUCAUACUAACGC | 856 |
| UAGCCGAGUAGUGUUGGGU | 161 | UAGCCGAGUAGUGUUGGGU | 161 | ACCCAACACUACUCGGCUA | 857 |
| AACUACUGUCUUCACGCAG | 162 | AACUACUGUCUUCACGCAG | 162 | CUGCGUGAAGACAGUAGUU | 858 |
| CGCGAAAGGCCUUGUGGUA | 163 | CGCGAAAGGCCUUGUGGUA | 163 | UACCACAAGGCCUUUCGCG | 859 |
| AGUGUUGGGUCGCGAAAGG | 164 | AGUGUUGGGUCGCGAAAGG | 164 | CCUUUCGCGACCCAACACU | 860 |
| GUUGGGUCGCGAAAGGCCU | 165 | GUUGGGUCGCGAAAGGCCU | 165 | AGGCCUUUCGCGACCCAAC | 861 |
| AGUAGUGUUGGGUCGCGAA | 166 | AGUAGUGUUGGGUCGCGAA | 166 | UUCGCGACCCAACACUACU | 862 |
| UUGGGUCGCGAAAGGCCUU | 167 | UUGGGUCGCGAAAGGCCUU | 167 | AAGGCCUUUCGCGACCCAA | 863 |
| UCCCCUGUGAGGAACUACU | 168 | UCCCCUGUGAGGAACUACU | 168 | AGUAGUUCCUCACAGGGGA | 864 |
| UACUGUCUUCACGCAGAAA | 169 | UACUGUCUUCACGCAGAAA | 169 | UUUCUGCGUGAAGACAGUA | 865 |
| GUGUUGGGUCGCGAAAGGC | 170 | GUGUUGGGUCGCGAAAGGC | 170 | GCCUUUCGCGACCCAACAC | 866 |
| ACUACUGUCUUCACGCAGA | 171 | ACUACUGUCUUCACGCAGA | 171 | UCUGCGUGAAGACAGUAGU | 867 |
| CUGUCUUCACGCAGAAAGC | 172 | CUGUCUUCACGCAGAAAGC | 172 | GCUUUCUGCGUGAAGACAG | 868 |
| GGGUCGCGAAAGGCCUUGU | 173 | GGGUCGCGAAAGGCCUUGU | 173 | ACAAGGCCUUUCGCGACCC | 869 |

TABLE II-continued

HCV siNA AND TARGET SEQUENCES

| Sequence | Seq ID | Upper seq | Seq ID | Lower seq | Seq ID |
|---|---|---|---|---|---|
| CCUAAACCUCAAAGAAAAA | 174 | CCUAAACCUCAAAGAAAAA | 174 | UUUUUCUUUGAGGUUUAGG | 870 |
| GGUCGCGAAAGGCCUUGUG | 175 | GGUCGCGAAAGGCCUUGUG | 175 | CACAAGGCCUUUCGCGACC | 871 |
| CUAAACCUCAAAGAAAAAC | 176 | CUAAACCUCAAAGAAAAAC | 176 | GUUUUUCUUUGAGGUUUAG | 872 |
| UGUUGGGUCGCGAAAGGCC | 177 | UGUUGGGUCGCGAAAGGCC | 177 | GGCCUUUCGCGACCCAACA | 873 |
| CUCCCCUGUGAGGAACUAC | 178 | CUCCCCUGUGAGGAACUAC | 178 | GUAGUUCCUCACAGGGGAG | 874 |
| UCCUAAACCUCAAAGAAAA | 179 | UCCUAAACCUCAAAGAAAA | 179 | UUUUCUUUGAGGUUUAGGA | 875 |
| ACCGGGUCCUUUCUUGGAU | 180 | ACCGGGUCCUUUCUUGGAU | 180 | AUCCAAGAAAGGACCCGGU | 876 |
| AAUCCUAAACCUCAAAGAA | 181 | AAUCCUAAACCUCAAAGAA | 181 | UUCUUUGAGGUUUAGGAUU | 877 |
| UCAAUGCCUGGAGAUUUGG | 182 | UCAAUGCCUGGAGAUUUGG | 182 | CCAAAUCUCCAGGCAUUGA | 878 |
| AUGCCUGGAGAUUUGGGCG | 183 | AUGCCUGGAGAUUUGGGCG | 183 | CGCCCAAAUCUCCAGGCAU | 879 |
| AAUGCCUGGAGAUUUGGGC | 184 | AAUGCCUGGAGAUUUGGGC | 184 | GCCCAAAUCUCCAGGCAUU | 880 |
| CCGACCUCAUGGGGUACAU | 185 | CCGACCUCAUGGGGUACAU | 185 | AUGUACCCCAUGAGGUCGG | 881 |
| GCUCAAUGCCUGGAGAUUU | 186 | GCUCAAUGCCUGGAGAUUU | 186 | AAAUCUCCAGGCAUUGAGC | 882 |
| CUCAAUGCCUGGAGAUUUG | 187 | CUCAAUGCCUGGAGAUUUG | 187 | CAAAUCUCCAGGCAUUGAG | 883 |
| GCUAGCCGAGUAGUGUUGG | 188 | GCUAGCCGAGUAGUGUUGG | 188 | CCAACACUACUCGGCUAGC | 884 |
| CGCUCAAUGCCUGGAGAUU | 189 | CGCUCAAUGCCUGGAGAUU | 189 | AAUCUCCAGGCAUUGAGCG | 885 |
| CAAUGCCUGGAGAUUUGGG | 190 | CAAUGCCUGGAGAUUUGGG | 190 | CCCAAAUCUCCAGGCAUUG | 886 |
| GCCGACCUCAUGGGGUACA | 191 | GCCGACCUCAUGGGGUACA | 191 | UGUACCCCAUGAGGUCGGC | 887 |
| AUCCUAAACCUCAAAGAAA | 192 | AUCCUAAACCUCAAAGAAA | 192 | UUUCUUUGAGGUUUAGGAU | 888 |
| AGAUUUGGGCGUGCCCCG | 193 | AGAUUUGGGCGUGCCCCG | 193 | CGGGGGCACGCCCAAAUCU | 889 |
| CCCGCUCAAUGCCUGGAGA | 194 | CCCGCUCAAUGCCUGGAGA | 194 | UCUCCAGGCAUUGAGCGGG | 890 |
| GAGAUUUGGGCGUGCCCCC | 195 | GAGAUUUGGGCGUGCCCCC | 195 | GGGGGCACGCCCAAAUCUC | 891 |
| GGAGAUUUGGGCGUGCCCC | 196 | GGAGAUUUGGGCGUGCCCC | 196 | GGGGCACGCCCAAAUCUCC | 892 |
| GAUUUGGGCGUGCCCCGC | 197 | GAUUUGGGCGUGCCCCGC | 197 | GCGGGGGCACGCCCAAAUC | 893 |
| CCGCUCAAUGCCUGGAGAU | 198 | CCGCUCAAUGCCUGGAGAU | 198 | AUCCAGGCAUUGAGCGG | 894 |
| AGUACACCGGAAUUGCCAG | 199 | AGUACACCGGAAUUGCCAG | 199 | CUGGCAAUUCCGGUGUACU | 895 |
| UACACCGGAAUUGCCAGGA | 200 | UACACCGGAAUUGCCAGGA | 200 | UCCUGGCAAUUCCGGUGUA | 896 |
| GAGUACACCGGAAUUGCCA | 201 | GAGUACACCGGAAUUGCCA | 201 | UGGCAAUUCCGGUGUACUC | 897 |
| GUACACCGGAAUUGCCAGG | 202 | GUACACCGGAAUUGCCAGG | 202 | CCUGGCAAUUCCGGUGUAC | 898 |
| UUGCCGCGCAGGGGCCCA | 203 | UUGCCGCGCAGGGGCCCCA | 203 | UGGGGCCCCUGCGCGGCAA | 899 |
| CUGGAGAUUUGGGCGUGCC | 204 | CUGGAGAUUUGGGCGUGCC | 204 | GGCACGCCCAAAUCUCCAG | 900 |
| GUUGCCGCGCAGGGGCCCC | 205 | GUUGCCGCGCAGGGGCCCC | 205 | GGGGCCCCUGCGCGGCAAC | 901 |
| GCCUGGAGAUUUGGGCGUG | 206 | GCCUGGAGAUUUGGGCGUG | 206 | CACGCCCAAAUCUCCAGGC | 902 |
| UGGAGAUUUGGGCGUGCCC | 207 | UGGAGAUUUGGGCGUGCCC | 207 | GGGCACGCCCAAAUCUCCA | 903 |
| CCUGGAGAUUUGGGCGUGC | 208 | CCUGGAGAUUUGGGCGUGC | 208 | GCACGCCCAAAUCUCCAGG | 904 |
| UGCUAGCCGAGUAGUGUUG | 209 | UGCUAGCCGAGUAGUGUUG | 209 | CAACACUACUCGGCUAGCA | 905 |
| UGCCUGGAGAUUUGGGCGU | 210 | UGCCUGGAGAUUUGGGCGU | 210 | ACGCCCAAAUCUCCAGGCA | 906 |

TABLE II-continued

HCV siNA AND TARGET SEQUENCES

| Sequence | Seq ID | Upper seq | Seq ID | Lower seq | Seq ID |
|---|---|---|---|---|---|
| CUGCUAGCCGAGUAGUGUU | 211 | CUGCUAGCCGAGUAGUGUU | 211 | AACACUACUCGGCUAGCAG | 907 |
| ACUGCUAGCCGAGUAGUGU | 212 | ACUGCUAGCCGAGUAGUGU | 212 | ACACUACUCGGCUAGCAGU | 908 |
| GACUGCUAGCCGAGUAGUG | 213 | GACUGCUAGCCGAGUAGUG | 213 | CACUACUCGGCUAGCAGUC | 909 |
| AGACUGCUAGCCGAGUAGU | 214 | AGACUGCUAGCCGAGUAGU | 214 | ACUACUCGGCUAGCAGUCU | 910 |
| ACCCGCUCAAUGCCUGGAG | 215 | ACCCGCUCAAUGCCUGGAG | 215 | CUCCAGGCAUUGAGCGGGU | 911 |
| AACCCGCUCAAUGCCUGGA | 216 | AACCCGCUCAAUGCCUGGA | 216 | UCCAGGCAUUGAGCGGGUU | 912 |
| UGCCGCGCAGGGGCCCCAG | 217 | UGCCGCGCAGGGGCCCCAG | 217 | CUGGGGCCCCUGCGCGGCA | 913 |
| AGGGGCCCCAGGUUGGGUG | 218 | AGGGGCCCCAGGUUGGGUG | 218 | CACCCAACCUGGGGCCCCU | 914 |
| GGGCCCCAGGUUGGGUGUG | 219 | GGGCCCCAGGUUGGGUGUG | 219 | CACACCCAACCUGGGGCCC | 915 |
| CAGGGGCCCCAGGUUGGGU | 220 | CAGGGGCCCCAGGUUGGGU | 220 | ACCCAACCUGGGGCCCCUG | 916 |
| GGCCCCAGGUUGGGUGUGC | 221 | GGCCCCAGGUUGGGUGUGC | 221 | GCACACCCAACCUGGGGCC | 917 |
| CGCAGGGGCCCCAGGUUGG | 222 | CGCAGGGGCCCCAGGUUGG | 222 | CCAACCUGGGGCCCCUGCG | 918 |
| UGGGCAGGAUGGCUCCUGU | 223 | UGGGCAGGAUGGCUCCUGU | 223 | ACAGGAGCCAUCCUGCCCA | 919 |
| GCCCCAGGUUGGGUGUGCG | 224 | GCCCCAGGUUGGGUGUGCG | 224 | CGCACACCCAACCUGGGGC | 920 |
| GCAGGGGCCCCAGGUUGGG | 225 | GCAGGGGCCCCAGGUUGGG | 225 | CCCAACCUGGGGCCCCUGC | 921 |
| GGGCAGGAUGGCUCCUGUC | 226 | GGGCAGGAUGGCUCCUGUC | 226 | GACAGGAGCCAUCCUGCCC | 922 |
| GGGGCCCCAGGUUGGGUGU | 227 | GGGGCCCCAGGUUGGGUGU | 227 | ACACCCAACCUGGGGCCCC | 923 |
| GCCGCGCAGGGGCCCCAGG | 228 | GCCGCGCAGGGGCCCCAGG | 228 | CCUGGGGCCCCUGCGCGGC | 924 |
| GCGCAGGGGCCCCAGGUUG | 229 | GCGCAGGGGCCCCAGGUUG | 229 | CAACCUGGGGCCCCUGCGC | 925 |
| CGCGCAGGGGCCCCAGGUU | 230 | CGCGCAGGGGCCCCAGGUU | 230 | AACCUGGGGCCCCUGCGCG | 926 |
| CCGCGCAGGGGCCCCAGGU | 231 | CCGCGCAGGGGCCCCAGGU | 231 | ACCUGGGGCCCCUGCGCGG | 927 |
| AGGACGACCGGGUCCUUUC | 232 | AGGACGACCGGGUCCUUUC | 232 | GAAAGGACCCGGUCGUCCU | 928 |
| CAGGACGACCGGGUCCUUU | 233 | CAGGACGACCGGGUCCUUU | 233 | AAAGGACCCGGUCGUCCUG | 929 |
| UGCCAGGACGACCGGGUCC | 234 | UGCCAGGACGACCGGGUCC | 234 | GGACCCGGUCGUCCUGGCA | 930 |
| AUUGCCAGGACGACCGGGU | 235 | AUUGCCAGGACGACCGGGU | 235 | ACCCGGUCGUCCUGGCAAU | 931 |
| AAUUGCCAGGACGACCGGG | 236 | AAUUGCCAGGACGACCGGG | 236 | CCCGGUCGUCCUGGCAAUU | 932 |
| UUGCCAGGACGACCGGGUC | 237 | UUGCCAGGACGACCGGGUC | 237 | GACCCGGUCGUCCUGGCAA | 933 |
| CCAGGACGACCGGGUCCUU | 238 | CCAGGACGACCGGGUCCUU | 238 | AAGGACCCGGUCGUCCUGG | 934 |
| GCCAGGACGACCGGGUCCU | 239 | GCCAGGACGACCGGGUCCU | 239 | AGGACCCGGUCGUCCUGGC | 935 |
| GAAUUGCCAGGACGACCGG | 240 | GAAUUGCCAGGACGACCGG | 240 | CCGGUCGUCCUGGCAAUUC | 936 |
| ACGACCGGGUCCUUUCUUG | 241 | ACGACCGGGUCCUUUCUUG | 241 | CAAGAAAGGACCCGGUCGU | 937 |
| GACGACCGGGUCCUUUCUU | 242 | GACGACCGGGUCCUUUCUU | 242 | AAGAAAGGACCCGGUCGUC | 938 |
| CGACCGGGUCCUUUCUUGG | 243 | CGACCGGGUCCUUUCUUGG | 243 | CCAAGAAAGGACCCGGUCG | 939 |
| GGACGACCGGGUCCUUUCU | 244 | GGACGACCGGGUCCUUUCU | 244 | AGAAAGGACCCGGUCGUCC | 940 |
| CCGGAAUUGCCAGGACGAC | 245 | CCGGAAUUGCCAGGACGAC | 245 | GUCGUCCUGGCAAUUCCGG | 941 |
| ACACCGGAAUUGCCAGGAC | 246 | ACACCGGAAUUGCCAGGAC | 246 | GUCCUGGCAAUUCCGGUGU | 942 |
| ACCGGAAUUGCCAGGACGA | 247 | ACCGGAAUUGCCAGGACGA | 247 | UCGUCCUGGCAAUUCCGGU | 943 |
| CGGAAUUGCCAGGACGACC | 248 | CGGAAUUGCCAGGACGACC | 248 | GGUCGUCCUGGCAAUUCCG | 944 |

TABLE II-continued

HCV siNA AND TARGET SEQUENCES

| Sequence | Seq ID | Upper seq | Seq ID | Lower seq | Seq ID |
|---|---|---|---|---|---|
| GGAAUUGCCAGGACGACCG | 249 | GGAAUUGCCAGGACGACCG | 249 | CGGUCGUCCUGGCAAUUCC | 945 |
| CACCGGAAUUGCCAGGACG | 250 | CACCGGAAUUGCCAGGACG | 250 | CGUCCUGGCAAUUCCGGUG | 946 |
| CCCCAGGUUGGGUGUGCGC | 251 | CCCCAGGUUGGGUGUGCGC | 251 | GCGCACACCCAACCUGGGG | 947 |
| GAUCGUUGGUGGAGUUUAC | 252 | GAUCGUUGGUGGAGUUUAC | 252 | GUAAACUCCACCAACGAUC | 948 |
| CAGAUCGUUGGUGGAGUUU | 253 | CAGAUCGUUGGUGGAGUUU | 253 | AAACUCCACCAACGAUCUG | 949 |
| AGAUCGUUGGUGGAGUUUA | 254 | AGAUCGUUGGUGGAGUUUA | 254 | UAAACUCCACCAACGAUCU | 950 |
| CCCAGGUUGGGUGUGCGCG | 255 | CCCAGGUUGGGUGUGCGCG | 255 | CGCGCACACCCAACCUGGG | 951 |
| CCAGGUUGGGUGUGCGCGC | 256 | CCAGGUUGGGUGUGCGCGC | 256 | GCGCGCACACCCAACCUGG | 952 |
| AGGUUGGGUGUGCGCGCGA | 257 | AGGUUGGGUGUGCGCGCGA | 257 | UCGCGCGCACACCCAACCU | 953 |
| CAGGUUGGGUGUGCGCGCG | 258 | CAGGUUGGGUGUGCGCGCG | 258 | CGCGCGCACACCCAACCUG | 954 |
| GGUUGGGUGUGCGCGCGAC | 259 | GGUUGGGUGUGCGCGCGAC | 259 | GUCGCGCGCACACCCAACC | 955 |
| GAAAAACCAAACGUAACAC | 260 | GAAAAACCAAACGUAACAC | 260 | GUGUUACGUUUGGUUUUUC | 956 |
| AGAAAAACCAAACGUAACA | 261 | AGAAAAACCAAACGUAACA | 261 | UGUUACGUUUGGUUUUUCU | 957 |
| AACCAAACGUAACACCAAC | 262 | AACCAAACGUAACACCAAC | 262 | GUUGGUGUUACGUUUGGUU | 958 |
| AAAGAAAAACCAAACGUAA | 263 | AAAGAAAAACCAAACGUAA | 263 | UUACGUUUGGUUUUUCUUU | 959 |
| AAAAACCAAACGUAACACC | 264 | AAAAACCAAACGUAACACC | 264 | GGUGUUACGUUUGGUUUUU | 960 |
| AAGAAAAACCAAACGUAAC | 265 | AAGAAAAACCAAACGUAAC | 265 | GUUACGUUUGGUUUUUCUU | 961 |
| CAAAGAAAAACCAAACGUA | 266 | CAAAGAAAAACCAAACGUA | 266 | UACGUUUGGUUUUUCUUUG | 962 |
| ACCCCCGGCGUAGGUCGCG | 267 | ACCCCCGGGGUAGGUCGCG | 267 | CGCGACCUACGCCGGGGGU | 963 |
| GACCCCCGGCGUAGGUCGC | 268 | GACCCCCGGCGUAGGUCGC | 268 | GCGACCUACGCCGGGGGUC | 964 |
| CGUUAGUAUGAGUGUCGUG | 269 | CGUUAGUAUGAGUGUCGUG | 269 | CACGACACUCAUACUAACG | 965 |
| GUUAGUAUGAGUGUCGUGC | 270 | GUUAGUAUGAGUGUCGUGC | 270 | GCACGACACUCAUACUAAC | 966 |
| UUAGUAUGAGUGUCGUGCA | 271 | UUAGUAUGAGUGUCGUGCA | 271 | UGCACGACACUCAUACUAA | 967 |
| CCAAACGUAACACCAACCG | 272 | CCAAACGUAACACCAACCG | 272 | CGGUUGGUGUUACGUUUGG | 968 |
| ACCAAACGUAACACCAACC | 273 | ACCAAACGUAACACCAACC | 273 | GGUUGGUGUUACGUUUGGU | 969 |
| UUGGGCGUGCCCCGCGAG | 274 | UUGGGCGUGCCCCGCGAG | 274 | CUCGCGGGGCACGCCCAA | 970 |
| AUUUGGGCGUGCCCCGCG | 275 | AUUUGGGCGUGCCCCGCG | 275 | CGCGGGGGCACGCCCAAAU | 971 |
| UUUGGGCGUGCCCCGCGA | 276 | UUUGGGCGUGCCCCGCGA | 276 | UCGCGGGGGCACGCCCAAA | 972 |
| AAACCAAACGUAACACCAA | 277 | AAACCAAACGUAACACCAA | 277 | UUGGUGUUACGUUUGGUUU | 973 |
| UGGGCGUGCCCCGCGAGA | 278 | UGGGCGUGCCCCGCGAGA | 278 | UCUCGCGGGGCACGCCCA | 974 |
| GUCAGAUCGUUGGUGGAGU | 279 | GUCAGAUCGUUGGUGGAGU | 279 | ACUCCACCAACGAUCUGAC | 975 |
| GUGUCGUGCAGCCUCCAGG | 280 | GUGUCGUGCAGCCUCCAGG | 280 | CCUGGAGGCUGCACGACAC | 976 |
| GGUCAGAUCGUUGGUGGAG | 281 | GGUCAGAUCGUUGGUGGAG | 281 | CUCCACCAACGAUCUGACC | 977 |
| AGUGUCGUGCAGGCUCCAG | 282 | AGUGUCGUGCAGCCUCCAG | 282 | CUGGAGGCUGCACGACACU | 978 |
| GAGUGUCGUGCAGCCUCCA | 283 | GAGUGUCGUGCAGCCUCCA | 283 | UGGAGGCUGCACGACACUC | 979 |
| UCGUAGACCGUGCACCAUG | 284 | UCGUAGACCGUGCACCAUG | 284 | CAUGGUGCACGGUCUACGA | 980 |
| GACCGUGCACCAUGAGCAC | 285 | GACCGUGCACCAUGAGCAC | 285 | GUGCUCAUGGUGCACGGUC | 981 |

TABLE II-continued

HCV siNA AND TARGET SEQUENCES

| Sequence | Seq ID | Upper seq | Seq ID | Lower seq | Seq ID |
|---|---|---|---|---|---|
| AGUAUGAGUGUCGUGCAGC | 286 | AGUAUGAGUGUCGUGCAGC | 286 | GCUGCACGACACUCAUACU | 982 |
| UAGUAUGAGUGUCGUGCAG | 287 | UAGUAUGAGUGUCGUGCAG | 287 | CUGCACGACACUCAUACUA | 983 |
| UCAGAUCGUUGGUGGAGUU | 288 | UCAGAUCGUUGGUGGAGUU | 288 | AACUCCACCAACGAUCUGA | 984 |
| AGACCGUGCACCAUGAGCA | 289 | AGACCGUGCACCAUGAGCA | 289 | UGCUCAUGGUGCACGGUCU | 985 |
| AAAACCAAACGUAACACCA | 290 | AAAACCAAACGUAACACCA | 290 | UGGUGUUACGUUUGGUUUU | 986 |
| GUAGACCGUGCACCAUGAG | 291 | GUAGACCGUGCACCAUGAG | 291 | CUCAUGGUGCACGGUCUAC | 987 |
| CUCGUAGACCGUGCACCAU | 292 | CUCGUAGACCGUGCACCAU | 292 | AUGGUGCACGGUCUACGAG | 988 |
| CGUAGACCGUGCACCAUGA | 293 | CGUAGACCGUGCACCAUGA | 293 | UCAUGGUGCACGGUCUACG | 989 |
| CCUGGGCUCAGCCCGGGUA | 294 | CCUGGGCUCAGCCCGGGUA | 294 | UACCCGGGCUGAGCCCAGG | 990 |
| UAGACCGUGCACCAUGAGC | 295 | UAGACCGUGCACCAUGAGC | 295 | GCUCAUGGUGCACGGUCUA | 991 |
| GGUCUCGUAGACCGUGCAC | 296 | GGUCUCGUAGACCGUGCAC | 296 | GUGCACGGUCUACGAGACC | 992 |
| UCUCGUAGACCGUGCACCA | 297 | UCUCGUAGACCGUGCACCA | 297 | UGGUGCACGGUCUACGAGA | 993 |
| GUCUCGUAGACCGUGCACC | 298 | GUCUCGUAGACCGUGCACC | 298 | GGUGCACGGUCUACGAGAC | 994 |
| UUGGGUAAGGUCAUCGAUA | 299 | UUGGGUAAGGUCAUCGAUA | 299 | UAUCGAUGACCUUACCCAA | 995 |
| UCGCCGACCUCAUGGGGUA | 300 | UCGCCGACCUCAUGGGGUA | 300 | UACCCCAUGAGGUCGGCGA | 996 |
| CCUCAAAGAAAAACCAAAC | 301 | CCUCAAAGAAAAACCAAAC | 301 | GUUUGGUUUUUCUUUGAGG | 997 |
| GGGCGUGCCCCGCGAGAC | 302 | GGGCGUGCCCCGCGAGAC | 302 | GUCUCGCGGGGCACGCCC | 998 |
| GGAUGAACCGGCUGAUAGC | 303 | GGAUGAACCGGCUGAUAGC | 303 | GCUAUCAGCCGGUUCAUCC | 999 |
| UGGAUGAACCGGCUGAUAG | 304 | UGGAUGAACCGGCUGAUAG | 304 | CUAUCAGCCGGUUCAUCCA | 1000 |
| CUCAAAGAAAAACCAAACG | 305 | CUGAAAGAAAAACCAAACG | 305 | CGUUUGGUUUUUCUUUGAG | 1001 |
| AGGAAGACUUCCGAGCGGU | 306 | AGGAAGACUUCCGAGCGGU | 306 | ACCGCUCGGAAGUCUUCCU | 1002 |
| UCAAAGAAAAACCAAACGU | 307 | UCAAAGAAAAACCAAACGU | 307 | ACGUUUGGUUUUUCUUUGA | 1003 |
| GGAAGACUUCCGAGCGGUC | 308 | GGAAGACUUCCGAGCGGUC | 308 | GACCGCUCGGAAGUCUUCC | 1004 |
| CGCCGACCUCAUGGGGUAC | 309 | CGCCGACCUCAUGGGGUAC | 309 | GUACCCCAUGAGGUCGGCG | 1005 |
| CUUCCGAGCGGUCGCAACC | 310 | CUUCCGAGCGGUCGCAACC | 310 | GGUUGCGACCGCUCGGAAG | 1006 |
| GGCGUGCCCCGCGAGACU | 311 | GGCGUGCCCCGCGAGACU | 311 | AGUCUCGCGGGGCACGCC | 1007 |
| UAUGAGUGUCGUGCAGCCU | 312 | UAUGAGUGUCGUGCAGCCU | 312 | AGGCUGCACGACACUCAUA | 1008 |
| UGCCCCGCGAGACUGCUA | 313 | UGCCCCGCGAGACUGCUA | 313 | UAGCAGUCUCGCGGGGCA | 1009 |
| CGAGACUGCUAGCCGAGUA | 314 | CGAGACUGCUAGCCGAGUA | 314 | UACUCGGCUAGCAGUCUCG | 1010 |
| UGAGUGUCGUGCAGCCUCC | 315 | UGAGUGUCGUGCAGCCUCC | 315 | GGAGGCUGCACGACACUCA | 1011 |
| GCCCCGCGAGACUGCUAG | 316 | GCCCCGCGAGACUGCUAG | 316 | CUAGCAGUCUCGCGGGGC | 1012 |
| GAGACUGGUAGCCGAGUAG | 317 | GAGACUGCUAGCCGAGUAG | 317 | CUACUCGGCUAGCAGUCUC | 1013 |
| CCCCCGCGAGACUGCUAGC | 318 | CCCCCGCGAGACUGCUAGC | 318 | GCUAGCAGUCUCGCGGGG | 1014 |
| CGCGAGACUGCUAGCCGAG | 319 | CGCGAGACUGCUAGCCGAG | 319 | CUCGGCUAGCAGUCUCGCG | 1015 |
| GUAUGAGUGUCGUGCAGCC | 320 | GUAUGAGUGUCGUGCAGCC | 320 | GGCUGCACGACACUCAUAC | 1016 |
| AUGAGUGUCGUGCAGCCUC | 321 | AUGAGUGUCGUGCAGCCUC | 321 | GAGGCUGCACGACACUCAU | 1017 |
| GCGAGACUGCUAGCCGAGU | 322 | GCGAGACUGCUAGCCGAGU | 322 | ACUCGGCUAGCAGUCUCGC | 1018 |
| CCCCGCGAGACUGCUAGCC | 323 | CCCCGCGAGACUGCUAGCC | 323 | GGCUAGCAGUCUCGCGGGG | 1019 |

TABLE II-continued

HCV siNA AND TARGET SEQUENCES

| Sequence | Seq ID | Upper seq | Seq ID | Lower seq | Seq ID |
|---|---|---|---|---|---|
| CCGCGAGACUGCUAGCCGA | 324 | CCGCGAGACUGCUAGCCGA | 324 | UCGGCUAGCAGUCUCGCGG | 1020 |
| CCCGCGAGACUGCUAGCCG | 325 | CCCGCGAGACUGCUAGCCG | 325 | CGGCUAGCAGUCUCGCGGG | 1021 |
| GCGUGCCCCGCGAGACUG | 326 | GCGUGCCCCGCGAGACUG | 326 | CAGUCUCGCGGGGCACGC | 1022 |
| GACCCCCCCUCCCGGGAGA | 327 | GACCCCCCCUCCCGGGAGA | 327 | UCUCCCGGGAGGGGGGGUC | 1023 |
| CGGGUCCUUUCUUGGAUCA | 328 | CGGGUCCUUUCUUGGAUCA | 328 | UGAUCCAAGAAAGGACCCG | 1024 |
| GUGCCCCGCGAGACUGCU | 329 | GUGCCCCGCGAGACUGCU | 329 | AGCAGUCUCGCGGGGCAC | 1025 |
| CGUGCCCCGCGAGACUGC | 330 | CGUGCCCCGCGAGACUGC | 330 | GCAGUCUCGCGGGGCACG | 1026 |
| UUCGCCGACCUCAUGGGGU | 331 | UUCGCCGACCUCAUGGGGU | 331 | ACCCCAUGAGGUCGGCGAA | 1027 |
| CGCCCACAGGACGUCAAGU | 332 | CGCCCACAGGACGUCAAGU | 332 | ACUUGACGUCCUGUGGGCG | 1028 |
| GCCCACAGGACGUCAAGUU | 333 | GCCCACAGGACGUCAAGUU | 333 | AACUUGACGUCCUGUGGGC | 1029 |
| ACCCCCCCUCCCGGGAGAG | 334 | ACCCCCCCUCCCGGGAGAG | 334 | CUCUCCCGGGAGGGGGGGU | 1030 |
| GGACCCCCCCUCCCGGGAG | 335 | GGACCCCCCCUCCCGGGAG | 335 | CUCCCGGGAGGGGGGGUCC | 1031 |
| CCGGGUCCUUUCUUGGAUC | 336 | CCGGGUCCUUUCUUGGAUC | 336 | GAUCCAAGAAAGGACCCGG | 1032 |
| CAGGACCCCCCCUCCCGGG | 337 | CAGGACCCCCCCUCCCGGG | 337 | CCCGGGAGGGGGGGUCCUG | 1033 |
| AGGACGUCAAGUUCCCGGG | 338 | AGGACGUCAAGUUCCCGGG | 338 | CCCGGGAACUUGACGUCCU | 1034 |
| AGGACCCCCCCUCCCGGGA | 339 | AGGACCCCCCCUCCCGGGA | 339 | UCCCGGGAGGGGGGGUCCU | 1035 |
| CCACAGGACGUCAAGUUCC | 340 | CCACAGGACGUCAAGUUCC | 340 | GGAACUUGACGUCCUGUGG | 1036 |
| CAGGACGUCAAGUUCCCGG | 341 | CAGGACGUCAAGUUCCCGG | 341 | CCGGGAACUUGACGUCCUG | 1037 |
| ACAGGACGUCAAGUUCCCG | 342 | ACAGGACGUCAAGUUCCCG | 342 | CGGGAACUUGACGUCCUGU | 1038 |
| CACAGGACGUCAAGUUCCC | 343 | CACAGGACGUCAAGUUCCC | 343 | GGGAACUUGACGUCCUGUG | 1039 |
| CAGUGGAUGAACCGGCUGA | 344 | CAGUGGAUGAACCGGCUGA | 344 | UCAGCCGGUUCAUCCACUG | 1040 |
| GGGCUCAGCCCGGGUACCC | 345 | GGGCUCAGCCCGGGUACCC | 345 | GGGUACCCGGGCUGAGCCC | 1041 |
| CCGAGCGGUCGCAACCUCG | 346 | CCGAGCGGUCGCAACCUCG | 346 | CGAGGUUGCGACCGCUCGG | 1042 |
| CUGGGCUCAGCCCGGGUAC | 347 | CUGGGCUCAGCCCGGGUAC | 347 | GUACCCGGGCUGAGCCCAG | 1043 |
| AGUGGAUGAACCGGCUGAU | 348 | AGUGGAUGAACCGGCUGAU | 348 | AUCAGCCGGUUCAUCCACU | 1044 |
| UCCGAGCGGUCGCAACCUC | 349 | UCCGAGCGGUCGCAACCUC | 349 | GAGGUUGCGACCGCUCGGA | 1045 |
| UGGGCUCAGCCCGGGUACC | 350 | UGGGCUCAGCCCGGGUACC | 350 | GGUACCCGGGCUGAGCCCA | 1046 |
| GGUACCUUGGCCCCUCUA | 351 | GGUACCCUUGGCCCCUCUA | 351 | UAGAGGGGCCAAGGGUACC | 1047 |
| UUCCGAGCGGUCGCAACCU | 352 | UUCCGAGCGGUCGCAACCU | 352 | AGGUUGCGACCGCUCGGAA | 1048 |
| GGGUACCCUUGGCCCCUCU | 353 | GGGUACCCUUGGCCCCUCU | 353 | AGAGGGGCCAAGGGUACCC | 1049 |
| GGGUCCUUUCUUGGAUCAA | 354 | GGGUCCUUUCUUGGAUCAA | 354 | UUGAUCCAAGAAAGGACCC | 1050 |
| CCCACAGGACGUCAAGUUC | 355 | CCCACAGGACGUCAAGUUC | 355 | GAACUUGACGUCCUGUGGG | 1051 |
| GGUUGCUCUUUCUCUAUCU | 356 | GGUUGCUCUUUCUCUAUCU | 356 | AGAUAGAGAAAGAGCAACC | 1052 |
| GUGGGCAGGAUGGCUCCUG | 357 | GUGGGCAGGAUGGCUCCUG | 357 | CAGGAGCCAUCCUGCCCAC | 1053 |
| GUGGGGCAGGAUGGCUCCU | 358 | GUGGGGCAGGAUGGCUCCU | 358 | AGGAGCCAUCCUGCCCACC | 1054 |
| GUUGCUCUUUCUCUAUCUU | 359 | GUUGCUCUUUCUCUAUCUU | 359 | AAGAUAGAGAAAGAGCAAC | 1055 |
| GUGGAUGAACCGGCUGAUA | 360 | GUGGAUGAACCGGCUGAUA | 360 | UAUCAGCCGGUUCAUCCAC | 1056 |

TABLE II-continued

HCV siNA AND TARGET SEQUENCES

| Sequence | Seq ID | Upper seq | Seq ID | Lower seq | Seq ID |
|---|---|---|---|---|---|
| CCAGGACCCCCCUCCCGG | 361 | CCAGGACCCCCCUCCCGG | 361 | CCGGGAGGGGGGUCCUGG | 1057 |
| GGGUGGGCAGGAUGGCUCC | 362 | GGGUGGGCAGGAUGGCUCC | 362 | GGAGCCAUCCUGCCCACCC | 1058 |
| CUUCACGGAGGCUAUGACU | 363 | CUUCACGGAGGCUAUGACU | 363 | AGUCAUAGCCUCCGUGAAG | 1059 |
| ACCGCCGCCCACAGGACGU | 364 | ACCGCCGCCCACAGGACGU | 364 | ACGUCCUGUGGGCGGCGGU | 1060 |
| UCCAGGACCCCCCUCCCG | 365 | UCCAGGACCCCCCUCCCG | 365 | CGGGAGGGGGGUCCUGGA | 1061 |
| AUAUGAUGAUGAACUGGUC | 366 | AUAUGAUGAUGAACUGGUC | 366 | GACCAGUUCAUCAUCAUAU | 1062 |
| UUCACGGAGGCUAUGACUA | 367 | UUCACGGAGGCUAUGACUA | 367 | UAGUCAUAGCCUCCGUGAA | 1063 |
| UCACGGAGGCUAUGACUAG | 368 | UCACGGAGGCUAUGACUAG | 368 | CUAGUCAUAGCCUCCGUGA | 1064 |
| AUGAACCGGCUGAUAGCGU | 369 | AUGAACCGGCUGAUAGCGU | 369 | ACGCUAUCAGCCGGUUCAU | 1065 |
| GGGAUAUGAUGAUGAACUG | 370 | GGGAUAUGAUGAUGAACUG | 370 | CAGUUCAUCAUCAUAUCCC | 1066 |
| UGCAGUGGAUGAACCGGCU | 371 | UGCAGUGGAUGAACCGGCU | 371 | AGCCGGUUCAUCCACUGCA | 1067 |
| GUGCAGUGGAUGAACCGGC | 372 | GUGCAGUGGAUGAACCGGC | 372 | GCCGGUUCAUCCACUGCAC | 1068 |
| UGAACCGGCUGAUAGCGUU | 373 | UGAACCGGCUGAUAGCGUU | 373 | AACGCUAUCAGCCGGUUCA | 1069 |
| GGAUAUGAUGAUGAACUGG | 374 | GGAUAUGAUGAUGAACUGG | 374 | CCAGUUCAUCAUCAUAUCC | 1070 |
| GCUCUUUCUCUAUCUUCCU | 375 | GCUCUUUCUCUAUCUUCCU | 375 | AGGAAGAUAGAGAAAGAGC | 1071 |
| GGGGGCGACACUCCACCAU | 376 | GGGGGCGACACUCCACCAU | 376 | AUGGUGGAGUGUCGCCCCC | 1072 |
| GAUGAACCGGCUGAUAGCG | 377 | GAUGAACCGGCUGAUAGCG | 377 | CGCUAUCAGCCGGUUCAUC | 1073 |
| GAUAUGAUGAUGAACUGGU | 378 | GAUAUGAUGAUGAACUGGU | 378 | ACCAGUUCAUCAUCAUAUC | 1074 |
| UGGGAUAUGAUGAUGAACU | 379 | UGGGAUAUGAUGAUGAACU | 379 | AGUUCAUCAUCAUAUCCCA | 1075 |
| UUGCUCUUUCUCUAUCUUC | 380 | UUGCUCUUUCUCUAUCUUC | 380 | GAAGAUAGAGAAAGAGCAA | 1076 |
| UGGGGGCGACACUCCACCA | 381 | UGGGGGCGACACUCCACCA | 381 | UGGUGGAGUGUCGCCCCCA | 1077 |
| UGCUCUUUCUCUAUCUUCC | 382 | UGCUCUUUCUCUAUCUUCC | 382 | GGAAGAUAGAGAAAGAGCA | 1078 |
| GGUCCUUUCUUGGAUCAAC | 383 | GGUCCUUUCUUGGAUCAAC | 383 | GUUGAUCCAAGAAAGGACC | 1079 |
| AAGACUUCCGAGCGGUCGC | 384 | AAGACUUCCGAGCGGUCGC | 384 | GCGACCGCUCGGAAGUCUU | 1080 |
| AGCCCGGGUACCCUUGGCC | 385 | AGCCCGGGUACCCUUGGCC | 385 | GGCCAAGGGUACCCGGGCU | 1081 |
| UUUCUUGGAUCAACCCGCU | 386 | UUUCUUGGAUCAACCCGCU | 386 | AGCGGGUUGAUCCAAGAAA | 1082 |
| CAGCCCGGGUACCCUUGGC | 387 | CAGCCCGGGUACCCUUGGC | 387 | GCCAAGGGUACCCGGGCUG | 1083 |
| AGACUUCCGAGCGGUCGCA | 388 | AGACUUCCGAGCGGUCGCA | 388 | UGCGACCGCUCGGAAGUCU | 1084 |
| UUCUUGGAUCAACCCGCUC | 389 | UUCUUGGAUCAACCCGCUC | 389 | GAGCGGGUUGAUCCAAGAA | 1085 |
| CCCGGGUACCCUUGGCCCC | 390 | CCCGGGUACCCUUGGCCCC | 390 | GGGGCCAAGGGUACCCGGG | 1086 |
| GUCCUUUCUUGGAUCAACC | 391 | GUCCUUUCUUGGAUCAACC | 391 | GGUUGAUCCAAGAAAGGAC | 1087 |
| CUUUCUUGGAUCAACCCGC | 392 | CUUUCUUGGAUCAACCCGC | 392 | GCGGGUUGAUCCAAGAAAG | 1088 |
| CCUUUCUUGGAUCAACCCG | 393 | CCUUUCUUGGAUCAACCCG | 393 | CGGGUUGAUCCAAGAAAGG | 1089 |
| UCCUUUCUUGGAUCAACCC | 394 | UCCUUUCUUGGAUCAACCC | 394 | GGGUUGAUCCAAGAAAGGA | 1090 |
| AAGUUCCCGGGCGGUGGUC | 395 | AAGUUCCCGGGCGGUGGUC | 395 | GACCACCGCCCGGGAACUU | 1091 |
| GCAGUGGAUGAACCGGCUG | 396 | GCAGUGGAUGAACCGGCUG | 396 | CAGCCGGUUCAUCCACUGC | 1092 |
| CCGGGUACCCUUGGCCCCU | 397 | CCGGGUACCCUUGGCCCCU | 397 | AGGGGCCAAGGGUACCCGG | 1093 |
| AGUUCCCGGGCGGUGGUCA | 398 | AGUUCCCGGGCGGUGGUCA | 398 | UGACCACCGCCCGGGAACU | 1094 |

TABLE II-continued

HCV siNA AND TARGET SEQUENCES

| Sequence | Seq ID | Upper seq | Seq ID | Lower seq | Seq ID |
|---|---|---|---|---|---|
| CUUGGAUCAACCCGCUCAA | 399 | CUUGGAUCAACCCGCUCAA | 399 | UUGAGCGGGUUGAUCCAAG | 1095 |
| GGAUCAACCCGCUCAAUGC | 400 | GGAUCAACCCGCUCAAUGC | 400 | GCAUUGAGCGGGUUGAUCC | 1096 |
| ACUUCCGAGCGGUCGCAAC | 401 | ACUUCCGAGCGGUCGCAAC | 401 | GUUGCGACCGCUCGGAAGU | 1097 |
| UCUUGGAUCAACCCGCUCA | 402 | UCUUGGAUCAACCCGCUCA | 402 | UGAGCGGGUUGAUCCAAGA | 1098 |
| UUGGAUCAACCCGCUCAAU | 403 | UUGGAUCAACCCGCUCAAU | 403 | AUUGAGCGGGUUGAUCCAA | 1099 |
| AACCGCCGCCCACAGGACG | 404 | AACCGCCGCCCACAGGACG | 404 | CGUCCUGUGGGCGGCGGUU | 1100 |
| GCGUGAACUAUGCAACAGG | 405 | GCGUGAACUAUGCAACAGG | 405 | CCUGUUGCAUAGUUCACGC | 1101 |
| AUCAACCCGCUCAAUGCCU | 406 | AUCAACCCGCUCAAUGCCU | 406 | AGGCAUUGAGCGGGUUGAU | 1102 |
| GAUCAACCCGCUCAAUGCC | 407 | GAUCAACCGGCUCAAUGCC | 407 | GGCAUUGAGCGGGUUGAUC | 1103 |
| CAACCCGCUCAAUGCCUGG | 408 | CAACCCGCUCAAUGCCUGG | 408 | CCAGGCAUUGAGCGGGUUG | 1104 |
| GCUUCGCCGACCUCAUGGG | 409 | GCUUCGCCGACCUCAUGGG | 409 | CCCAUGAGGUCGGCGAAGC | 1105 |
| GACUUCCGAGCGGUCGCAA | 410 | GACUUCCGAGCGGUCGCAA | 410 | UUGCGACCGCUCGGAAGUC | 1106 |
| UCAACCCGCUCAAUGCCUG | 411 | UCAACCCGCUCAAUGCCUG | 411 | CAGGCAUUGAGCGGGUUGA | 1107 |
| GGCUUCGCCGACCUCAUGG | 412 | GGCUUCGCCGACCUCAUGG | 412 | CCAUGAGGUCGGCGAAGCC | 1108 |
| UGGAUCAACCCGCUCAAUG | 413 | UGGAUCAACCCGCUCAAUG | 413 | CAUUGAGCGGGUUGAUCCA | 1109 |
| CGGGCGGUGGUCAGAUCGU | 414 | CGGGCGGUGGUCAGAUCGU | 414 | ACGAUCUGACCACCGGCCG | 1110 |
| CUUGGCCCCUCUAUGGCAA | 415 | CUUGGCCCCUCUAUGGCAA | 415 | UUGCCAUAGAGGGGCCAAG | 1111 |
| CCGGGCGGUGGUCAGAUCG | 416 | CCGGGCGGUGGUCAGAUCG | 416 | CGAUCUGACCACCGCCCGG | 1112 |
| UGGGGUGGGCAGGAUGGCU | 417 | UGGGGUGGGCAGGAUGGCU | 417 | AGCCAUCCUGCCCACCCCA | 1113 |
| GGAGUUUACCUGUUGCCGC | 418 | GGAGUUUACCUGUUGCCGC | 418 | GCGGCAACAGGUAAACUCC | 1114 |
| CCUUGGCCCCUCUAUGGCA | 419 | CCUUGGCCCCUCUAUGGCA | 419 | UGCCAUAGAGGGGCCAAGG | 1115 |
| GUGGAGUUUACCUGUUGCC | 420 | GUGGAGUUUACCUGUUGCC | 420 | GGCAACAGGUAAACUCCAC | 1116 |
| GGUGGAGUUUACCUGUUGC | 421 | GGUGGAGUUUACCUGUUGC | 421 | GCAACAGGUAAACUCCACC | 1117 |
| UUCCCGGGCGGUGGUCAGA | 422 | UUCCCGGGCGGUGGUCAGA | 422 | UCUGACCACCGCCCGGGAA | 1118 |
| UGAACUAUGCAACAGGGAA | 423 | UGAACUAUGCAACAGGGAA | 423 | UUGCCUGUUGCAUAGUUCA | 1119 |
| AGUUUACCUGUUGCCGCGC | 424 | AGUUUACCUGUUGCCGCGC | 424 | GCGCGGCAACAGGUAAACU | 1120 |
| GUGAACUAUGCAACAGGGA | 425 | GUGAACUAUGCAACAGGGA | 425 | UCCCUGUUGCAUAGUUCAC | 1121 |
| UUACCUGUUGCCGCGCAGG | 426 | UUACCUGUUGCCGCGCAGG | 426 | CCUGCGCGGCAACAGGUAA | 1122 |
| UCCCGGGCGGUGGUCAGAU | 427 | UCCCGGGCGGUGGUCAGAU | 427 | AUCUGACCACCGCCCGGGA | 1123 |
| GUUCCCGGGCGGUGGUCAG | 428 | GUUCCCGGGCGGUGGUCAG | 428 | CUGACCACCGCCCGGGAAC | 1124 |
| GCCCGGGUACCCUUGGCCC | 429 | GCCCGGGUACCCUUGGCCC | 429 | GGGCCAAGGGUACCCGGGC | 1125 |
| AAGGAGAUGAAGGCGAAGG | 430 | AAGGAGAUGAAGGCGAAGG | 430 | CCUUCGCCUUCAUCUCCUU | 1126 |
| AGGAGAUGAAGGCGAAGGC | 431 | AGGAGAUGAAGGCGAAGGC | 431 | GCCUUCGCCUUCAUCUCCU | 1127 |
| GUUUACCUGUUGCCGCGCA | 432 | GUUUACCUGUUGCCGCGCA | 432 | UGCGCGGCAACAGGUAAAC | 1128 |
| CUGUUGCCGCGCAGGGGCC | 433 | CUGUUGCCGCGCAGGGGCC | 433 | GGCCCCUGCGCGGCAACAG | 1129 |
| AACACCAACCGCCGCCCAC | 434 | AACACCAACCGCCGCCCAC | 434 | GUGGGCGGCGGUUGGUGUU | 1130 |
| GAGUUUACCUGUUGCCGCG | 435 | GAGUUUACCUGUUGCCGCG | 435 | CGCGGCAACAGGUAAACUC | 1131 |

TABLE II-continued

HCV siNA AND TARGET SEQUENCES

| Sequence | Seq ID | Upper seq | Seq ID | Lower seq | Seq ID |
|---|---|---|---|---|---|
| UUUACCUGUUGCCGCGCAG | 436 | UUUACCUGUUGCCGCGCAG | 436 | CUGCGCGGCAACAGGUAAA | 1132 |
| GGGGUGGGCAGGAUGGCUC | 437 | GGGGUGGGCAGGAUGGCUC | 437 | GAGCCAUCCUGCCCACCCC | 1133 |
| GAAGACUUCCGAGCGGUCG | 438 | GAAGACUUCCGAGCGGUCG | 438 | CGACCGCUCGGAAGUCUUC | 1134 |
| ACCUGUUGCCGCGCAGGGG | 439 | ACCUGUUGCCGCGCAGGGG | 439 | CCCCUGCGCGGCAACAGGU | 1135 |
| UACCUGUUGCCGCGCAGGG | 440 | UACCUGUUGCCGCGCAGGG | 440 | CCCUGCGCGGCAACAGGUA | 1136 |
| UACCUCUUCAACUGGGCAG | 441 | UACCUCUUCAACUGGGCAG | 441 | CUGCCCAGUUGAAGAGGUA | 1137 |
| CGUGAACUAUGCAACAGGG | 442 | CGUGAACUAUGCAACAGGG | 442 | CCCUGUUGCAUAGUUCACG | 1138 |
| ACACCAACCGCCGCCCACA | 443 | ACACCAACCGCCGCCCACA | 443 | UGUGGGCGGCGGUUGGUGU | 1139 |
| CCCGGGCGGUGGUCAGAUC | 444 | CCCGGGCGGUGGUCAGAUC | 444 | GAUCUGACCACCGCCCGGG | 1140 |
| ACCUCUUCAACUGGGCAGU | 445 | ACCUCUUCAACUGGGCAGU | 445 | ACUGCCCAGUUGAAGAGGU | 1141 |
| CUUCGCCGACCUCAUGGGG | 446 | CUUCGCCGACCUCAUGGGG | 446 | CCCCAUGAGGUCGGCGAAG | 1142 |
| CCUGUUGCCGCGCAGGGGC | 447 | CCUGUUGCCGCGCAGGGGC | 447 | GCCCCUGCGCGGCAACAGG | 1143 |
| CCAACCGCCGCCCACAGGA | 448 | CCAACCGCCGCCCACAGGA | 448 | UCCUGUGGGCGGCGGUUGG | 1144 |
| ACCAACCGCCGCCCACAGG | 449 | ACCAACCGCCGCCCACAGG | 449 | CCUGUGGGCGGCGGUUGGU | 1145 |
| UGGAGUUUACCUGUUGCCG | 450 | UGGAGUUUACCUGUUGCCG | 450 | CGGCAACAGGUAAACUCCA | 1146 |
| CACCAACCGCCGCCCACAG | 451 | CACCAACCGCCGCCCACAG | 451 | CUGUGGGCGGCGGUUGGUG | 1147 |
| CAAACGUAACACCAACCGC | 452 | CAAACGUAACACCAACCGC | 452 | GCGGUUGGUGUUACGUUUG | 1148 |
| CAAGCGGAGACGGCUGGAG | 453 | CAAGCGGAGACGGCUGGAG | 453 | CUCCAGCCGUCUCCGCUUG | 1149 |
| ACGGAGGCUAUGACUAGGU | 454 | ACGGAGGCUAUGACUAGGU | 454 | ACCUAGUCAUAGCCUCCGU | 1150 |
| UAACACCAACCGCCGCCCA | 455 | UAACACCAACCGCCGCCCA | 455 | UGGGCGGCGGUUGGUGUUA | 1151 |
| AUCGUUGGUGGAGUUUACC | 456 | AUCGUUGGUGGAGUUUACC | 456 | GGUAAACUCCACCAACGAU | 1152 |
| GGGAGACAUAUAUCACAGC | 457 | GGGAGACAUAUAUCACAGC | 457 | GCUGUGAUAUAUGUCUGCC | 1153 |
| AACCUCGUGGAAGGCGACA | 458 | AACCUCGUGGAAGGCGACA | 458 | UGUCGCCUUCCACGAGGUU | 1154 |
| GGGGGAGACAUAUAUCACA | 459 | GGGGGAGACAUAUAUCACA | 459 | UGUGAUAUAUGUCUCCCCC | 1155 |
| AACGUAACACCAAGCGCCG | 460 | AACGUAACACCAACCGCCG | 460 | CGGCGGUUGGUGUUACGUU | 1156 |
| AAACGUAACACCAACCGCC | 461 | AAACGUAACACCAACCGCC | 461 | GGCGGUUGGUGUUACGUUU | 1157 |
| GGGGAGACAUAUAUCACAG | 462 | GGGGAGACAUAUAUCACAG | 462 | CUGUGAUAUAUGUCUCCCC | 1158 |
| GAGAUGAAGGCGAAGGCGU | 463 | GAGAUGAAGGCGAAGGCGU | 463 | ACGCCUUCGCCUUCAUCUC | 1159 |
| AAGCGGAGACGGCUGGAGC | 464 | AAGCGGAGACGGCUGGAGC | 464 | GCUCCAGCCGUCUCCGCUU | 1160 |
| GUACCCUUGGCCCCUCUAU | 465 | GUACCCUUGGCCCCUCUAU | 465 | AUAGAGGGGCCAAGGGUAC | 1161 |
| CCUCCAGGACCCCCCCUCC | 466 | CCUCCAGGACCCCCCCUCC | 466 | GGAGGGGGGUCCUGGAGG | 1162 |
| CUCCAGGACCCCCCCUCCC | 467 | CUCCAGGACCCCCCCUCCC | 467 | GGGAGGGGGGUCCUGGAG | 1163 |
| UACCCUUGGCCCCUCUAUG | 468 | UACCCUUGGCCCCUCUAUG | 468 | CAUAGAGGGGCCAAGGGUA | 1164 |
| CAACCUCGUGGAAGGCGAC | 469 | CAACCUCGUGGAAGGCGAC | 469 | GUCGCCUUCCACGAGGUUG | 1165 |
| CGGAGGCUAUGACUAGGUA | 470 | CGGAGGCUAUGACUAGGUA | 470 | UACCUAGUCAUAGCCUCCG | 1166 |
| GGAGAUGAAGGCGAAGGCG | 471 | GGAGAUGAAGGCGAAGGCG | 471 | CGCCUUCGCCUUCAUCUCC | 1167 |
| AGAUGAAGGCGAAGGCGUC | 472 | AGAUGAAGGCGAAGGCGUC | 472 | GACGCCUUCGCCUUCAUCU | 1168 |
| GUAACACCAACCGCCGCCC | 473 | GUAACACCAACCGCCGCCC | 473 | GGGCGGCGGUUGGUGUUAC | 1169 |

TABLE II-continued

HCV siNA AND TARGET SEQUENCES

| Sequence | Seq ID | Upper seq | Seq ID | Lower seq | Seq ID |
|---|---|---|---|---|---|
| CGUAACACCAACCGCCGCC | 474 | CGUAACACCAACCGCCGCC | 474 | GGCGGCGGUUGGUGUUACG | 1170 |
| ACGUAACACCAACCGCCGC | 475 | ACGUAACACCAACCGCCGC | 475 | GCGGCGGUUGGUGUUACGU | 1171 |
| CACGGAGGCUAUGACUAGG | 476 | CACGGAGGCUAUGACUAGG | 476 | CCUAGUCAUAGCCUGCGUG | 1172 |
| GUUGGUGGAGUUUACCUGU | 477 | GUUGGUGGAGUUUACCUGU | 477 | ACAGGUAAACUCCACCAAC | 1173 |
| CGUUGGUGGAGUUUACCUG | 478 | CGUUGGUGGAGUUUACCUG | 478 | CAGGUAAACUCCACCAACG | 1174 |
| ACCCUUGGCCCCUCUAUGG | 479 | ACCCUUGGCCCCUCUAUGG | 479 | CCAUAGAGGGGCCAAGGGU | 1175 |
| UUGGUGGAGUUUACCUGUU | 480 | UUGGUGGAGUUUACCUGUU | 480 | AACAGGUAAACUCCACCAA | 1176 |
| UGGUGGAGUUUACCUGUUG | 481 | UGGUGGAGUUUACCUGUUG | 481 | CAACAGGUAAACUCCACCA | 1177 |
| UCGUUGGUGGAGUUUACCU | 482 | UCGUUGGUGGAGUUUACCU | 482 | AGGUAAACUCCACCAACGA | 1178 |
| CGGGUACCCUUGGCCGCUC | 483 | CGGGUACCCUUGGCCCCUC | 483 | GAGGGGCCAAGGGUACCCG | 1179 |
| GGCUCAGCCCGGGUACCCU | 484 | GGCUCAGCCCGGGUACCCU | 484 | AGGGUAGCCGGGCUGAGCC | 1180 |
| GAUCACUCCCCUGUGAGGA | 485 | GAUCACUCCCCUGUGAGGA | 485 | UCCUCACAGGGGAGUGAUC | 1181 |
| GGUGGUCAGAUCGUUGGUG | 486 | GGUGGUCAGAUCGUUGGUG | 486 | CACCAACGAUCUGACCACC | 1182 |
| GAUGAAGGCGAAGGCGUCC | 487 | GAUGAAGGCGAAGGCGUCC | 487 | GGACGCCUUCGCCUUCAUC | 1183 |
| AGGAUGGCUCCUGUCACCC | 488 | AGGAUGGCUCCUGUCACCC | 488 | GGGUGACAGGAGCCAUCCU | 1184 |
| CUCAGCCCGGGUACCCUUG | 489 | CUCAGCCCGGGUACCCUUG | 489 | CAAGGGUACCCGGGCUGAG | 1185 |
| UCAGCCCGGGUACCCUUGG | 490 | UCAGCCCGGGUACCCUUGG | 490 | CCAAGGGUACCCGGGCUGA | 1186 |
| AUGAAGGCGAAGGCGUCCA | 491 | AUGAAGGCGAAGGCGUCCA | 491 | UGGACGCCUUCGCCUUCAU | 1187 |
| CGGGGGAGACAUAUAUCAC | 492 | CGGGGGAGACAUAUAUCAC | 492 | GUGAUAUAUGUCUCCCCCG | 1188 |
| CAGGAUGGCUCCUGUCACC | 493 | CAGGAUGGCUCCUGUCACC | 493 | GGUGACAGGAGCCAUCCUG | 1189 |
| UGAAGGCGAAGGCGUCCAC | 494 | UGAAGGCGAAGGCGUCCAC | 494 | GUGGACGCCUUCGCCUUCA | 1190 |
| UGGUCAGAUCGUUGGUGGA | 495 | UGGUCAGAUCGUUGGUGGA | 495 | UCCACCAACGAUCUGACCA | 1191 |
| GCUCAGCCCGGGUACCCUU | 496 | GCUCAGCCCGGGUACCCUU | 496 | AAGGGUACCCGGGCUGAGC | 1192 |
| GUGGUCAGAUCGUUGGUGG | 497 | GUGGUCAGAUCGUUGGUGG | 497 | CCACCAACGAUCUGACCAC | 1193 |
| CAGCCUCCAGGACCCCCCC | 498 | CAGCCUCCAGGACCCCCCC | 498 | GGGGGGGUCCUGGAGGCUG | 1194 |
| GGCGGUGGUCAGAUCGUUG | 499 | GGCGGUGGUCAGAUCGUUG | 499 | CAACGAUCUGACCACCGCC | 1195 |
| GCCUCCAGGACCCCCCCUC | 500 | GCCUCCAGGACCCCCCCUC | 500 | GAGGGGGGGUCCUGGAGGC | 1196 |
| AACCGGCUGAUAGCGUUCG | 501 | AACCGGCUGAUAGCGUUCG | 501 | CGAACGCUAUCAGCCGGUU | 1197 |
| AGCCUCCAGGACCCCCCCU | 502 | AGCCUCCAGGACCCCCCCU | 502 | AGGGGGGGUCCUGGAGGCU | 1198 |
| CGGCUUCGCCGACCUCAUG | 503 | CGGCUUCGCCGACCUCAUG | 503 | CAUGAGGUCGGCGAAGCCG | 1199 |
| GCGGAGACGGCUGGAGCGC | 504 | GCGGAGACGGCUGGAGCGC | 504 | GCGCUCCAGCCGUCUCCGC | 1200 |
| UCAUGGGGUACAUUCCGCU | 505 | UCAUGGGGUACAUUCCGCU | 505 | AGCGGAAUGUACCCCAUGA | 1201 |
| GAACCGGCUGAUAGCGUUC | 506 | GAACCGGCUGAUAGCGUUC | 506 | GAACGCUAUCAGCCGGUUC | 1202 |
| GCGGUGGUCAGAUCGUUGG | 507 | GCGGUGGUCAGAUCGUUGG | 507 | CCAACGAUCUGACCACCGC | 1203 |
| GGCAGGAUGGCUCCUGUCA | 508 | GGCAGGAUGGCUCCUGUCA | 508 | UGACAGGAGCCAUCCUGCC | 1204 |
| GCAGGAUGGCUCCUGUCAC | 509 | GCAGGAUGGCUCCUGUCAC | 509 | GUGACAGGAGCCAUCCUGC | 1205 |
| AUUUGGGUAAGGUCAUCGA | 510 | AUUUGGGUAAGGUCAUCGA | 510 | UCGAUGACCUUAGCCAAAU | 1206 |

TABLE II-continued

HCV siNA AND TARGET SEQUENCES

| Sequence | Seq ID | Upper seq | Seq ID | Lower seq | Seq ID |
|---|---|---|---|---|---|
| ACCGGCUGAUAGCGUUCGC | 511 | ACCGGCUGAUAGCGUUCGC | 511 | GCGAACGCUAUCAGCCGGU | 1207 |
| CGGAGACGGCUGGAGCGCG | 512 | CGGAGACGGCUGGAGCGCG | 512 | CGCGCUCCAGCCGUCUCCG | 1208 |
| GCGGCUUCGCCGACCUCAU | 513 | GCGGCUUCGCCGACCUCAU | 513 | AUGAGGUCGGCGAAGCCGC | 1209 |
| AAUUUGGGUAAGGUCAUCG | 514 | AAUUUGGGUAAGGUCAUCG | 514 | CGAUGACCUUACCCAAAUU | 1210 |
| GGGCGGUGGUCAGAUCGUU | 515 | GGGCGGUGGUCAGAUCGUU | 515 | AACGAUCUGACCACCGCCC | 1211 |
| CAACCGCCGCCCACAGGAC | 516 | CAACCGCCGCCCACAGGAC | 516 | GUCCUGUGGGCGGCGGUUG | 1212 |
| UGCGGCUUCGCCGACCUCA | 517 | UGCGGCUUCGCCGACCUCA | 517 | UGAGGUCGGCGAAGCCGCA | 1213 |
| CGGUGGUCAGAUCGUUGGU | 518 | CGGUGGUCAGAUCGUUGGU | 518 | ACCAACGAUCUGACCACCG | 1214 |
| UUGGGUGUGCGCGCGACUA | 519 | UUGGGUGUGCGCGCGACUA | 519 | UAGUCGCGCGCACACCCAA | 1215 |
| GUGUGCGCGCGACUAGGAA | 520 | GUGUGCGCGCGACUAGGAA | 520 | UUCCUAGUCGCGCGCACAC | 1216 |
| GAUGGCUCCUGUCACCCCG | 521 | GAUGGCUCCUGUCACCCCG | 521 | CGGGGUGACAGGAGCCAUC | 1217 |
| GGAUGGCUCCUGUCACCCC | 522 | GGAUGGCUCCUGUCACCCC | 522 | GGGGUGACAGGAGCCAUCC | 1218 |
| UGUGCGCGCGACUAGGAAG | 523 | UGUGCGCGCGACUAGGAAG | 523 | CUUCCUAGUCGCGCGCACA | 1219 |
| UGGGUGUGCGCGCGACUAG | 524 | UGGGUGUGCGCGCGACUAG | 524 | CUAGUCGCGCGCACACCCA | 1220 |
| GGUGUGCGCGCGACUAGGA | 525 | GGUGUGCGCGCGACUAGGA | 525 | UCCUAGUCGCGCGCACACC | 1221 |
| GGGUGUGCGCGCGACUAGG | 526 | GGGUGUGCGCGCGACUAGG | 526 | CCUAGUCGCGCGCACACCC | 1222 |
| CCCCGGCGUAGGUCGCGUA | 527 | CCCCGGCGUAGGUCGCGUA | 527 | UACGCGACCUACGCCGGGG | 1223 |
| GAAGGCGACAACCUAUCCC | 528 | GAAGGCGACAACCUAUCCC | 528 | GGGAUAGGUUGUCGCCUUC | 1224 |
| CCCGGCGUAGGUCGCGUAA | 529 | CCCGGCGUAGGUCGCGUAA | 529 | UUACGCGACCUACGCCGGG | 1225 |
| AGCGGAGACGGCUGGAGCG | 530 | AGCGGAGACGGCUGGAGCG | 530 | CGCUCCAGCCGUCUCCGCU | 1226 |
| CCCCCGGCGUAGGUCGCGU | 531 | CCCCCGGCGUAGGUCGCGU | 531 | ACGCGACCUACGCCGGGGG | 1227 |
| AGGCGAAGGCGUCCACAGU | 532 | AGGCGAAGGCGUCCACAGU | 532 | ACUGUGGACGCCUUCGCCU | 1228 |
| AAGGCGAAGGCGUCCACAG | 533 | AAGGCGAAGGCGUCCACAG | 533 | CUGUGGACGCCUUCGCCUU | 1229 |
| GUUGGGUGUGCGCGCGACU | 534 | GUUGGGUGUGCGCGCGACU | 534 | AGUCGCGCGCACACCCAAC | 1230 |
| CUCAUGGGGUACAUUCCGC | 535 | CUCAUGGGGUACAUUCCGC | 535 | GCGGAAUGUACCCCAUGAG | 1231 |
| GGAAGGCGACAACCUAUCC | 536 | GGAAGGCGACAACCUAUCC | 536 | GGAUAGGUUGUCGCCUUCC | 1232 |
| GCAAGUUCCUUGCCGACGG | 537 | GCAAGUUCCUUGCCGACGG | 537 | CCGUCGGCAAGGAACUUGC | 1233 |
| UGCAGCCUCCAGGACCCCC | 538 | UGCAGCCUCCAGGACCCCC | 538 | GGGGGUCCUGGAGGCUGCA | 1234 |
| GGACUGCACGAUGCUCGUG | 539 | GGACUGCACGAUGCUCGUG | 539 | CACGAGCAUCGUGCAGUCC | 1235 |
| GAAGGCGAAGGCGUCCACA | 540 | GAAGGCGAAGGCGUCCACA | 540 | UGUGGACGCCUUCGCCUUC | 1236 |
| GCAACCUCGUGGAAGGCGA | 541 | GCAACCUCGUGGAAGGCGA | 541 | UCGCCUUCCACGAGGUUGC | 1237 |
| GACGCGGGCUGUGCUUGGU | 542 | GACGCGGGCUGUGCUUGGU | 542 | ACCAAGCACAGCCCGCGUC | 1238 |
| ACGCGGGCUGUGCUUGGUA | 543 | ACGCGGGCUGUGCUUGGUA | 543 | UACCAAGCACAGCCCGCGU | 1239 |
| GUGCAGCCUCCAGGACCCC | 544 | GUGCAGCCUCCAGGACCCC | 544 | GGGGUCCUGGAGGCUGCAC | 1240 |
| GCAGCCUCCAGGACCCCCC | 545 | GCAGCCUCCAGGACCCCCC | 545 | GGGGGGUCCUGGAGGCUGC | 1241 |
| CGCAACCUCGUGGAAGGCG | 546 | CGCAACCUCGUGGAAGGCG | 546 | CGCCUUCCACGAGGUUGCG | 1242 |
| UGUCGUGCAGCCUCCAGGA | 547 | UGUCGUGCAGCCUCCAGGA | 547 | UCCUGGAGGCUGCACGACA | 1243 |
| AUGGCUUGGGAUAUGAUGA | 548 | AUGGCUUGGGAUAUGAUGA | 548 | UCAUCAUAUCCCAAGCCAU | 1244 |

TABLE II-continued

HCV siNA AND TARGET SEQUENCES

| Sequence | Seq ID | Upper seq | Seq ID | Lower seq | Seq ID |
|---|---|---|---|---|---|
| CUUGGGAUAUGAUGAUGAA | 549 | CUUGGGAUAUGAUGAUGAA | 549 | UUCAUCAUCAUAUCCCAAG | 1245 |
| CCCUUGGCCCCUCUAUGGC | 550 | CCCUUGGCCCCUCUAUGGC | 550 | GCCAUAGAGGGGCCAAGGG | 1246 |
| UGGCUUGGGAUAUGAUGAU | 551 | UGGCUUGGGAUAUGAUGAU | 551 | AUCAUCAUAUCCCAAGCCA | 1247 |
| CUGUGCAGUGGAUGAACCG | 552 | CUGUGCAGUGGAUGAACCG | 552 | CGGUUCAUCCACUGCACAG | 1248 |
| AUGACGCGGGCUGUGCUUG | 553 | AUGACGCGGGCUGUGCUUG | 553 | CAAGCACAGCCCGCGUCAU | 1249 |
| GCUUGGGAUAUGAUGAUGA | 554 | GCUUGGGAUAUGAUGAUGA | 554 | UCAUCAUCAUAUCCCAAGC | 1250 |
| UAUGACGCGGGCUGUGCUU | 555 | UAUGACGCGGGCUGUGCUU | 555 | AAGCACAGCCCGCGUCAUA | 1251 |
| UGACGCGGGCUGUGCUUGG | 556 | UGACGCGGGCUGUGCUUGG | 556 | CCAAGCACAGCCCGCGUCA | 1252 |
| GGCUUGGGAUAUGAUGAUG | 557 | GGCUUGGGAUAUGAUGAUG | 557 | CAUCAUCAUAUCCCAAGCC | 1253 |
| UGUGCAGUGGAUGAACCGG | 558 | UGUGCAGUGGAUGAACCGG | 558 | CCGGUUCAUCCACUGCACA | 1254 |
| GCUGUGCAGUGGAUGAACC | 559 | GCUGUGCAGUGGAUGAACC | 559 | GGUUCAUCCACUGCACAGC | 1255 |
| CUCUUCAACUGGGCAGUAA | 560 | CUCUUCAACUGGGCAGUAA | 560 | UUACUGCCCAGUUGAAGAG | 1256 |
| CCUCGUGGAAGGCGACAAC | 561 | CCUCGUGGAAGGCGACAAC | 561 | GUUGUCGCCUUCCACGAGG | 1257 |
| UGUGUCACCCAGACAGUCG | 562 | UGUGUCACCCAGACAGUCG | 562 | CGACUGUCUGGGUGACACA | 1258 |
| GGCGUGAACUAUGCAACAG | 563 | GGCGUGAACUAUGCAACAG | 563 | CUGUUGCAUAGUUCACGCC | 1259 |
| CGGCGUGAACUAUGCAACA | 564 | CGGCGUGAACUAUGCAACA | 564 | UGUUGCAUAGUUCACGCCG | 1260 |
| GUGUCACCCAGACAGUCGA | 565 | GUGUCACCCAGACAGUCGA | 565 | UCGACUGUCUGGGUGACAC | 1261 |
| CCUCUUCAACUGGGCAGUA | 566 | CCUCUUCAACUGGGCAGUA | 566 | UACUGCCCAGUUGAAGAGG | 1262 |
| CGUGGAAGGCGACAACCUA | 567 | CGUGGAAGGCGACAACCUA | 567 | UAGGUUGUCGCCUUCCACG | 1263 |
| UCGUGGAAGGCGACAACCU | 568 | UCGUGGAAGGCGACAACCU | 568 | AGGUUGUCGCCUUCCACGA | 1264 |
| CGGCCUAGUUGGGCCCCA | 569 | CGGCCUAGUUGGGCCCCA | 569 | UGGGGCCCCAACUAGGCCG | 1265 |
| CGACUAGGAAGACUUCCGA | 570 | CGACUAGGAAGACUUCCGA | 570 | UCGGAAGUCUUCCUAGUCG | 1266 |
| UUUGGGUAAGGUCAUCGAU | 571 | UUUGGGUAAGGUCAUCGAU | 571 | AUCGAUGACCUUACCCAAA | 1267 |
| GUGGAAGGCGACAACCUAU | 572 | GUGGAAGGCGACAACCUAU | 572 | AUAGGUUGUCGCCUUCCAC | 1268 |
| ACCUCGUGGAAGGCGACAA | 573 | ACCUCGUGGAAGGCGACAA | 573 | UUGUCGCCUUCCACGAGGU | 1269 |
| GCGACUAGGAAGACUUCCG | 574 | GCGACUAGGAAGACUUCCG | 574 | CGGAAGUCUUCCUAGUCGC | 1270 |
| GUCGUGCAGCCUCCAGGAC | 575 | GUCGUGCAGCCUCCAGGAC | 575 | GUCCUGGAGGCUGCACGAC | 1271 |
| UAGGAAGACUUCCGAGCGG | 576 | UAGGAAGACUUCCGAGCGG | 576 | CCGCUCGGAAGUCUUCCUA | 1272 |
| ACGGCGUGAACUAUGCAAC | 577 | ACGGCGUGAACUAUGCAAC | 577 | GUUGCAUAGUUCACGCCGU | 1273 |
| CUCGUGGAAGGCGACAACC | 578 | CUCGUGGAAGGCGACAACC | 578 | GGUUGUCGCCUUCCACGAG | 1274 |
| GGUCGCAACCUCGUGGAAG | 579 | GGUCGCAACCUCGUGGAAG | 579 | CUUCCACGAGGUUGCGACC | 1275 |
| CGGUCGCAACCUCGUGGAA | 580 | CGGUCGCAACCUCGUGGAA | 580 | UUCCACGAGGUUGCGACCG | 1276 |
| GCGCGCGACUAGGAAGACU | 581 | GCGCGCGACUAGGAAGACU | 581 | AGUCUUCCUAGUCGCGCGC | 1277 |
| GACGGCGUGAACUAUGCAA | 582 | GACGGCGUGAACUAUGCAA | 582 | UUGCAUAGUUCACGCCGUC | 1278 |
| UAGAUCACUCCCCUGUGAG | 583 | UAGAUCACUCCCCUGUGAG | 583 | CUCACAGGGGAGUGAUCUA | 1279 |
| AGCGGUCGCAACCUCGUGG | 584 | AGCGGUCGCAACCUCGUGG | 584 | CCACGAGGUUGCGACCGCU | 1280 |
| UGGAAGGCGACAACCUAUC | 585 | UGGAAGGCGACAACCUAUC | 585 | GAUAGGUUGUCGCCUUCCA | 1281 |

TABLE II-continued

HCV siNA AND TARGET SEQUENCES

| Sequence | Seq ID | Upper seq | Seq ID | Lower seq | Seq ID |
|---|---|---|---|---|---|
| CGCGCGACUAGGAAGACUU | 586 | CGCGCGACUAGGAAGACUU | 586 | AAGUCUUCCUAGUCGCGCG | 1282 |
| CUAGGAAGACUUCCGAGCG | 587 | CUAGGAAGACUUCCGAGCG | 587 | CGCUCGGAAGUCUUCCUAG | 1283 |
| GUGCGCGCGACUAGGAAGA | 588 | GUGCGCGCGACUAGGAAGA | 588 | UCUUCCUAGUCGCGCGCAC | 1284 |
| AGAUCACUCCCCUGUGAGG | 589 | AGAUCACUCCCCUGUGAGG | 589 | CCUCACAGGGGAGUGAUCU | 1285 |
| UGCGCGCGACUAGGAAGAC | 590 | UGCGCGCGACUAGGAAGAC | 590 | GUCUUCCUAGUCGCGCGCA | 1286 |
| AUAGAUCACUCCCCUGUGA | 591 | AUAGAUCACUCCCCUGUGA | 591 | UCACAGGGGAGUGAUCUAU | 1287 |
| GAGCGGUCGCAACCUCGUG | 592 | GAGCGGUCGCAACCUCGUG | 592 | CACGAGGUUGCGACCGCUC | 1288 |
| CACGAACGACUGCUCCAAC | 593 | CACGAACGACUGCUCCAAC | 593 | GUUGGAGCAGUCGUUCGUG | 1289 |
| GGCAAGUUCCUUGCCGACG | 594 | GGCAAGUUCCUUGCCGACG | 594 | CGUCGGCAAGGAACUUGCC | 1290 |
| UCGUGCAGCCUCCAGGACC | 595 | UCGUGCAGCCUCCAGGACC | 595 | GGUCCUGGAGGCUGCACGA | 1291 |
| GUCACGAACGACUGCUCCA | 596 | GUCACGAACGACUGCUCCA | 596 | UGGAGCAGUCGUUCGUGAC | 1292 |
| GCGGUCGCAACCUCGUGGA | 597 | GCGGUCGCAACCUCGUGGA | 597 | UCCACGAGGUUGCGACCGC | 1293 |
| GCGCGACUAGGAAGACUUC | 598 | GCGCGACUAGGAAGACUUC | 598 | GAAGUCUUCCUAGUCGCGC | 1294 |
| GCUAUGACGCGGGCUGUGC | 599 | GCUAUGACGCGGGCUGUGC | 599 | GCACAGCCCGCGUCAUAGC | 1295 |
| UCACGAACGACUGCUCCAA | 600 | UCACGAACGACUGCUCCAA | 600 | UUGGAGCAGUCGUUCGUGA | 1296 |
| UCGCAACCUCGUGGAAGGC | 601 | UCGCAACCUCGUGGAAGGC | 601 | GCCUUCCACGAGGUUGCGA | 1297 |
| CGUGCAGCCUCCAGGACCC | 602 | CGUGCAGCCUCCAGGACCC | 602 | GGGUCCUGGAGGCUGCACG | 1298 |
| GUCGCAACCUCGUGGAAGG | 603 | GUCGCAACCUCGUGGAAGG | 603 | CCUUCCACGAGGUUGCGAC | 1299 |
| ACUAGGAAGACUUCCGAGC | 604 | ACUAGGAAGACUUCCGAGC | 604 | GCUCGGAAGUCUUCCUAGU | 1300 |
| CGCGACUAGGAAGACUUCC | 605 | CGCGACUAGGAAGACUUCC | 605 | GGAAGUCUUCCUAGUCGCG | 1301 |
| UGGGCGAAGCACAUGUGGA | 606 | UGGGCGAAGCACAUGUGGA | 606 | UCCACAUGUGCUUCGCCCA | 1302 |
| CCUUGCCUACUAUUCCAUG | 607 | CCUUGCCUACUAUUCCAUG | 607 | CAUGGAAUAGUAGGCAAGG | 1303 |
| GCCUCAGGAAACUUGGGGU | 608 | GCCUCAGGAAACUUGGGGU | 608 | ACCCCAAGUUUCCUGAGGC | 1304 |
| UGCUAUGACGCGGGCUGUG | 609 | UGCUAUGACGCGGGCUGUG | 609 | CACAGCCCGCGUCAUAGCA | 1305 |
| UCGUGCUCGCCACCGCUAC | 610 | UCGUGCUCGCCACCGCUAC | 610 | GUAGCGGUGGCGAGCACGA | 1306 |
| UGCCUCAGGAAACUUGGGG | 611 | UGCCUCAGGAAACUUGGGG | 611 | CCCCAAGUUUCCUGAGGCA | 1307 |
| UGUCUCGUGCCCGACCCCG | 612 | UGUCUCGUGCCCGACCCCG | 612 | CGGGGUCGGGCACGAGACA | 1308 |
| UGUGGCGGCAGGAGAUGGG | 613 | UGUGGCGGCAGGAGAUGGG | 613 | CCCAUCUCCUGCCGCCACA | 1309 |
| GUGGUGCUCGCCACCGCUA | 614 | GUCGUGCUCGCCACCGCUA | 614 | UAGCGGUGGCGAGCACGAC | 1310 |
| GAUUUCCACUACGUGACGG | 615 | GAUUUCCACUACGUGACGG | 615 | CCGUCACGUAGUGGAAAUC | 1311 |
| GGGCCUUGCCUACUAUUCC | 616 | GGGCCUUGCCUACUAUUCC | 616 | GGAAUAGUAGGCAAGGCCC | 1312 |
| GCCUUGCCUACUAUUCCAU | 617 | GCCUUGCCUACUAUUCCAU | 617 | AUGGAAUAGUAGGCAAGGC | 1313 |
| GACUAGGAAGACUUCCGAG | 618 | GACUAGGAAGACUUCCGAG | 618 | CUCGGAAGUCUUCCUAGUC | 1314 |
| GCGGGGGAGACAUAUAUCA | 619 | GCGGGGGAGACAUAUAUCA | 619 | UGAUAUAUGUCUCCCCCGC | 1315 |
| CGAGCGGUCGCAACCUCGU | 620 | CGAGCGGUCGCAACCUCGU | 620 | ACGAGGUUGCGACCGCUCG | 1316 |
| GGCCUUGCCUACUAUUCCA | 621 | GGCCUUGCCUACUAUUCCA | 621 | UGGAAUAGUAGGCAAGGCC | 1317 |
| AUUUCCACUACGUGACGGG | 622 | AUUUCCACUACGUGACGGG | 622 | CCCGUCACGUAGUGGAAAU | 1318 |
| GGACGUCAAGUUCCCGGGC | 623 | GGACGUCAAGUUCCCGGGC | 623 | GCCCGGGAACUUGACGUCC | 1319 |

TABLE II-continued

HCV siNA AND TARGET SEQUENCES

| Sequence | Seq ID | Upper seq | Seq ID | Lower seq | Seq ID |
|---|---|---|---|---|---|
| GAGUGCUAUGACGCGGGCU | 624 | GAGUGCUAUGACGCGGGCU | 624 | AGCCCGCGUCAUAGCACUC | 1320 |
| GACGUCAAGUUCCCGGGCG | 625 | GACGUCAAGUUCCCGGGCG | 625 | CGCCCGGGAACUUGACGUC | 1321 |
| UCAGCGACGGGUCUUGGUC | 626 | UCAGCGACGGGUCUUGGUC | 626 | GACCAAGACCCGUCGCUGA | 1322 |
| UCAAGUUCCCGGGCGGUGG | 627 | UCAAGUUCCCGGGCGGUGG | 627 | CCACCGCCCGGGAACUUGA | 1323 |
| UCAAGGAGAUGAAGGCGAA | 628 | UCAAGGAGAUGAAGGCGAA | 628 | UUCGCCUUCAUCUCCUUGA | 1324 |
| CCUAUCCCCAAGGCUCGCC | 629 | CCUAUCCCCAAGGCUCGCC | 629 | GGCGAGCCUUGGGGAUAGG | 1325 |
| CUUGACCUACCUCAGAUCA | 630 | CUUGACCUACCUCAGAUCA | 630 | UGAUCUGAGGUAGGUCAAG | 1326 |
| UUUCCACUACGUGACGGGC | 631 | UUUCCACUACGUGACGGGC | 631 | GCCCGUCACGUAGUGGAAA | 1327 |
| AGUGCUAUGACGCGGGCUG | 632 | AGUGCUAUGACGCGGGCUG | 632 | CAGCCCGCGUCAUAGCACU | 1328 |
| ACGUCAAGUUCCCGGGCGG | 633 | ACGUCAAGUUCCCGGGCGG | 633 | CCGCCCGGGAACUUGACGU | 1329 |
| UCUGGAGACAUCGGGCCAG | 634 | UCUGGAGACAUCGGGCCAG | 634 | CUGGCCCGAUGUCUCCAGA | 1330 |
| GGGCGAAGCACAUGUGGAA | 635 | GGGCGAAGCACAUGUGGAA | 635 | UUCCACAUGUGCUUCGCCC | 1331 |
| UUGACCUACCUCAGAUCAU | 636 | UUGACCUACCUCAGAUCAU | 636 | AUGAUCUGAGGUAGGUCAA | 1332 |
| CCAAGCGGAGACGGCUGGA | 637 | CCAAGCGGAGACGGCUGGA | 637 | UCCAGCCGUCUCCGCUUGG | 1333 |
| ACCAAGCGGAGACGGCUGG | 638 | ACCAAGCGGAGACGGCUGG | 638 | CCAGCCGUCUCCGCUUGGU | 1334 |
| GGGUGGCUUCAUGCCUCAG | 639 | GGGUGGCUUCAUGCCUCAG | 639 | CUGAGGCAUGAAGCCACCC | 1335 |
| GUCAAGUUCCCGGGCGGUG | 640 | GUCAAGUUCCCGGGCGGUG | 640 | CACCGCCCGGGAACUUGAC | 1336 |
| CUCAAGGAGAUGAAGGCGA | 641 | CUCAAGGAGAUGAAGGCGA | 641 | UCGCCUUCAUCUCCUUGAG | 1337 |
| GACCAAGCGGAGACGGCUG | 642 | GACCAAGCGGAGACGGCUG | 642 | CAGCCGUCUCCGCUUGGUC | 1338 |
| UCCAGGUCGGGCUCAACCA | 643 | UCCAGGUCGGGCUCAACCA | 643 | UGGUUGAGCCCGACCUGGA | 1339 |
| CUCUUUCUCUAUCUUCCUC | 644 | CUCUUUCUCUAUCUUCCUC | 644 | GAGGAAGAUAGAGAAAGAG | 1340 |
| GUCUGGAGACAUCGGGCCA | 645 | GUCUGGAGACAUCGGGCCA | 645 | UGGCCCGAUGUCUCCAGAC | 1341 |
| GUUGUGACUUGGCCCCCGA | 646 | GUUGUGACUUGGCCCCCGA | 646 | UCGGGGGCCAAGUCACAAC | 1342 |
| AGACCUGGCUCCAGUCCAA | 647 | AGACCUGGCUCCAGUCCAA | 647 | UUGGACUGGAGCCAGGUCU | 1343 |
| CUUGCCUACUAUUCCAUGG | 648 | CUUGCCUACUAUUCCAUGG | 648 | CCAUGGAAUAGUAGGCAAG | 1344 |
| CCCGGUUGCUCUUUCUCUA | 649 | CCCGGUUGCUCUUUCUCUA | 649 | UAGAGAAAGAGCAACCGGG | 1345 |
| CUUUCUCUAUCUUCCUCUU | 650 | CUUUCUCUAUCUUCCUCUU | 650 | AAGAGGAAGAUAGAGAAAG | 1346 |
| AGGGUGGCUUCAUGCCUCA | 651 | AGGGUGGCUUCAUGCCUCA | 651 | UGAGGCAUGAAGCCACCCU | 1347 |
| AAGACCUGGCUCCAGUCCA | 652 | AAGACCUGGCUCCAGUCCA | 652 | UGGACUGGAGCCAGGUCUU | 1348 |
| CCGGUUGCUCUUUCUCUAU | 653 | CCGGUUGCUCUUUCUCUAU | 653 | AUAGAGAAAGAGCAACCGG | 1349 |
| CGGUUGCUCUUUCUCUAUC | 654 | CGGUUGCUCUUUCUCUAUC | 654 | GAUAGAGAAAGAGCAACCG | 1350 |
| UGGGGGAUUUCCACUACGU | 655 | UGGGGGAUUUCCACUACGU | 655 | ACGUAGUGGAAAUCCCCCA | 1351 |
| AUGUCACGAACGACUGCUC | 656 | AUGUCACGAACGACUGCUC | 656 | GAGCAGUCGUUCGUGACAU | 1352 |
| GGCCUAGUUGGGGCCCCAC | 657 | GGCCUAGUUGGGGCCCCAC | 657 | GUGGGGCCCCAACUAGGCC | 1353 |
| UGGACCAAGCGGAGACGGC | 658 | UGGACCAAGCGGAGACGGC | 658 | GCCGUCUCCGCUUGGUCCA | 1354 |
| UUCCAGGUCGGGCUCAACC | 659 | UUCCAGGUCGGGCUCAACC | 659 | GGUUGAGCCCGACCUGGAA | 1355 |
| AGCGGGUCGAGUUCCUGGU | 660 | AGCGGGUCGAGUUCCUGGU | 660 | ACCAGGAACUCGACCCGCU | 1356 |

TABLE II-continued

HCV siNA AND TARGET SEQUENCES

| Sequence | Seq ID | Upper seq | Seq ID | Lower seq | Seq ID |
|---|---|---|---|---|---|
| CAAGGAGAUGAAGGCGAAG | 661 | CAAGGAGAUGAAGGCGAAG | 661 | CUUCGCCUUCAUCUCCUUG | 1357 |
| CAUGUCACGAACGACUGCU | 662 | CAUGUCACGAACGACUGCU | 662 | AGCAGUCGUUCGUGACAUG | 1358 |
| CAGCGGGUCGAGUUCCUGG | 663 | CAGCGGGUCGAGUUCCUGG | 663 | CCAGGAACUCGACCCGCUG | 1359 |
| UUCCACUACGUGACGGGCA | 664 | UUCCACUACGUGACGGGCA | 664 | UGCCCGUCACGUAGUGGAA | 1360 |
| UAGGGUGGCUUCAUGCCUC | 665 | UAGGGUGGCUUCAUGCCUC | 665 | GAGGCAUGAAGCCACCCUA | 1361 |
| UCCAGGACUGCACGAUGCU | 666 | UCCAGGACUGCACGAUGCU | 666 | AGCAUCGUGCAGUCCUGGA | 1362 |
| UCCACUACGUGACGGGCAU | 667 | UCCACUACGUGACGGGCAU | 667 | AUGCCCGUCACGUAGUGGA | 1363 |
| AAUAGGGUGGCUUCAUGCC | 668 | AAUAGGGUGGCUUCAUGCC | 668 | GGCAUGAAGCCACCCUAUU | 1364 |
| GUCUUCACGGAGGCUAUGA | 669 | GUCUUCACGGAGGCUAUGA | 669 | UCAUAGCCUCCGUGAAGAC | 1365 |
| AUAGGGUGGCUUCAUGCCU | 670 | AUAGGGUGGCUUCAUGCCU | 670 | AGGCAUGAAGCCACCCUAU | 1366 |
| UCUUCACGGAGGCUAUGAC | 671 | UCUUCACGGAGGCUAUGAC | 671 | GUCAUAGCCUCCGUGAAGA | 1367 |
| AUGCCUCAGGAAACUUGGG | 672 | AUGCCUCAGGAAACUUGGG | 672 | CCCAAGUUUCCUGAGGCAU | 1368 |
| ACCGGGACGUGCUCAAGGA | 673 | ACCGGGACGUGCUCAAGGA | 673 | UCCUUGAGCACGUCCCGGU | 1369 |
| GGGGCUGUGCAGUGGAUGA | 674 | GGGGCUGUGCAGUGGAUGA | 674 | UCAUCCACUGCACAGCCCC | 1370 |
| AAGCUCCAGGACUGCACGA | 675 | AAGCUCCAGGACUGCACGA | 675 | UCGUGCAGUCCUGGAGCUU | 1371 |
| GCUCCAGGACUGCACGAUG | 676 | GCUCCAGGACUGCACGAUG | 676 | CAUCGUGCAGUCCUGGAGC | 1372 |
| UACCGGGACGUGCUCAAGG | 677 | UACCGGGACGUGCUCAAGG | 677 | CCUUGAGCACGUCCCGGUA | 1373 |
| GGGCUGUGCAGUGGAUGAA | 678 | GGGCUGUGCAGUGGAUGAA | 678 | UUCAUCCACUGCACAGCCC | 1374 |
| CGUCAAGUUCCCGGGCGGU | 679 | CGUCAAGUUCCCGGGCGGU | 679 | ACCGCCCGGGAACUUGACG | 1375 |
| UCAAUAGGGUGGCUUCAUG | 680 | UCAAUAGGGUGGCUUCAUG | 680 | CAUGAAGCCACCCUAUUGA | 1376 |
| AGUCUUCACGGAGGCUAUG | 681 | AGUCUUCACGGAGGCUAUG | 681 | CAUAGCCUCCGUGAAGACU | 1377 |
| GGACCAAGCGGAGACGGCU | 682 | GGACCAAGCGGAGACGGCU | 682 | AGCCGUCUCCGCUUGGUCC | 1378 |
| GGCUCCAGUCCAAGCUCCU | 683 | GGCUCCAGUCCAAGCUCCU | 683 | AGGAGCUUGGACUGGAGCC | 1379 |
| GGCUGUGCAGUGGAUGAAC | 684 | GGCUGUGCAGUGGAUGAAC | 684 | GUUCAUCCACUGCACAGCC | 1380 |
| CUCCAGGACUGCACGAUGC | 685 | CUCCAGGACUGCACGAUGC | 685 | GCAUCGUGCAGUCCUGGAG | 1381 |
| GAGUCUUCACGGAGGCUAU | 686 | GAGUCUUCACGGAGGCUAU | 686 | AUAGCCUCCGUGAAGACUC | 1382 |
| UGGCUCCAGUCCAAGCUCC | 687 | UGGCUCCAGUCCAAGCUCC | 687 | GGAGCUUGGACUGGAGCCA | 1383 |
| GGGGAUUUCCACUACGUGA | 688 | GGGGAUUUCCACUACGUGA | 688 | UCACGUAGUGGAAAUCCCC | 1384 |
| CAUGCCUCAGGAAACUUGG | 689 | CAUGCCUCAGGAAACUUGG | 689 | CCAAGUUUCCUGAGGCAUG | 1385 |
| AUCAAUAGGGUGGCUUCAU | 690 | AUCAAUAGGGUGGCUUCAU | 690 | AUGAAGCCACCCUAUUGAU | 1386 |
| GCGGGCCUUGCCUACUAUU | 691 | GCGGGCCUUGCCUACUAUU | 691 | AAUAGUAGGCAAGGCCCGC | 1387 |
| CCGGGACGUGCUCAAGGAG | 692 | CCGGGACGUGCUCAAGGAG | 692 | CUCCUUGAGCACGUCCCGG | 1388 |
| CCAUGGUGGGAACUGGGC | 693 | CCAUGGUGGGGAACUGGGC | 693 | GCCCAGUUCCCCACCAUGG | 1389 |
| CAAUAGGGUGGCUUCAUGC | 694 | CAAUAGGGUGGCUUCAUGC | 694 | GCAUGAAGCCACCCUAUUG | 1390 |
| AGCUCCAGGACUGCACGAU | 695 | AGCUCCAGGACUGCACGAU | 695 | AUCGUGCAGUCCUGGAGCU | 1391 |
| CGGGCCUUGCCUACUAUUC | 696 | CGGGCCUUGCCUACUAUUC | 696 | GAAUAGUAGGCAAGGCCCG | 1392 |

Figure 4:
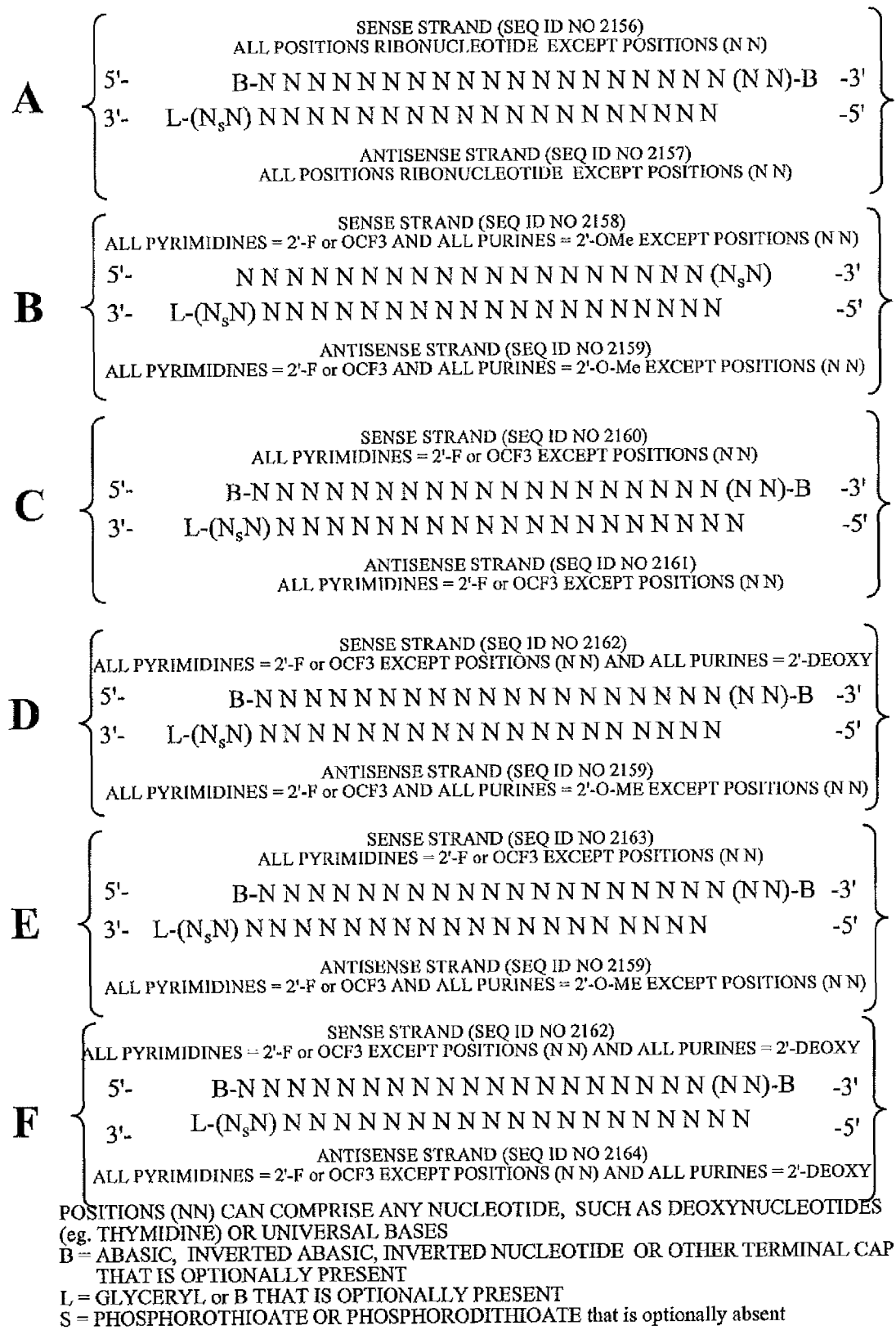
FIG. 4A-F shows non-limiting examples of chemically-modified siNA constructs of the present invention. In the figure, N stands for any nucleotide (adenosine, guanosine, cytosine, uridine, or optionally thymidine, for example thymidine can be substituted in the overhanging regions designated by parenthesis (N N). Various modifications are shown for the sense and antisense strands of the siNA constructs. The (N N) nucleotide positions can be chemically modified as described herein (e.g., 2'-O-methyl, 2'-deoxy-2'-fluoro etc.) and can be either derived from a corresponding target nucleic acid sequence or not (see for example FIG. 6C). Furthermore, the sequences shown in FIG. 4 can optionally include a ribonucleotide at the $9^{th}$ position from the 5'-end of the sense strand or the $11^{th}$ position based on the 5'-end of the guide strand by counting 11 nucleotide positions in from the 5'-terminus of the guide strand (see FIG. 6C).
Figure 5:
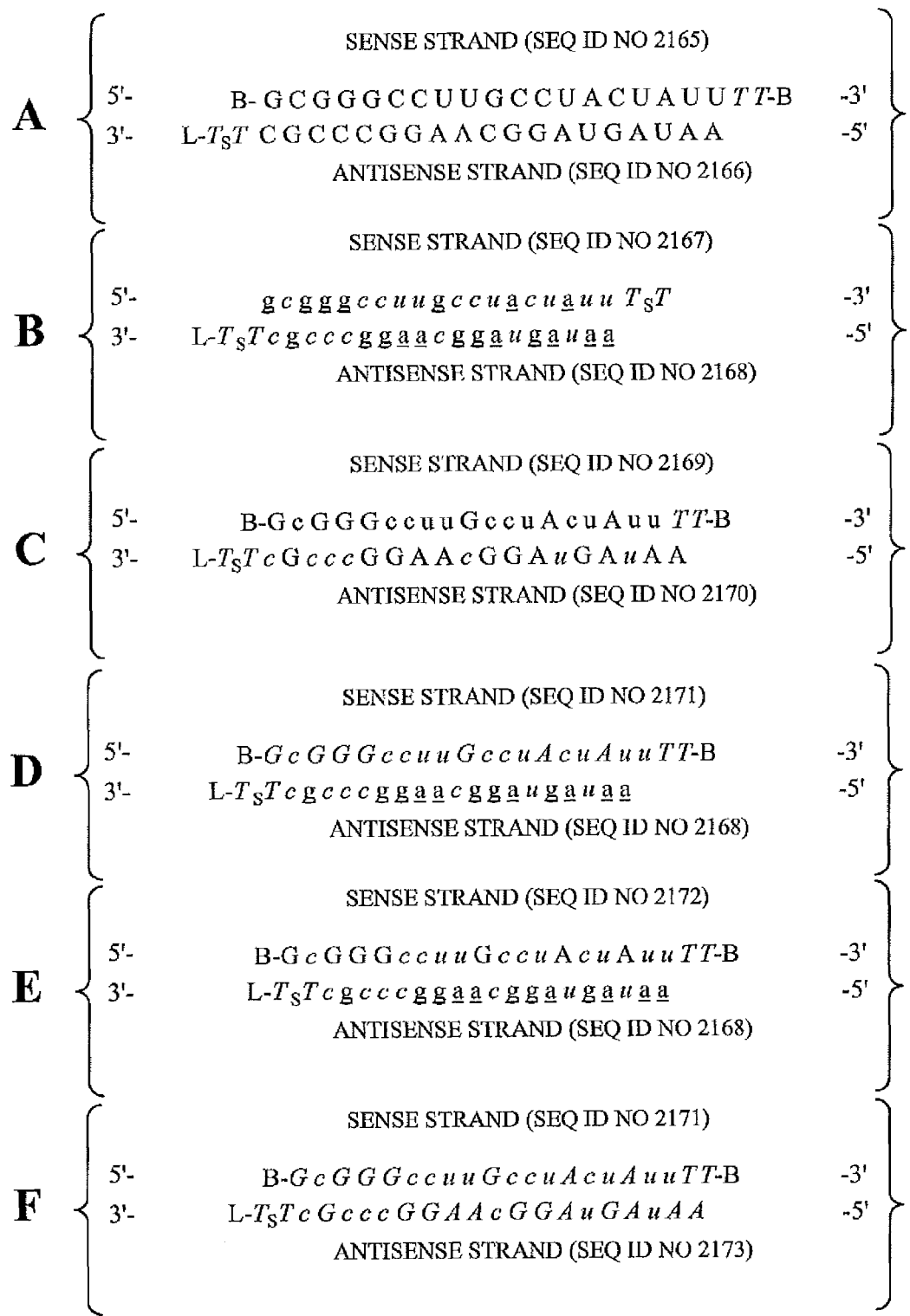
FIG. 5A-F shows non-limiting examples of specific chemically-modified siNA sequences of the invention. A-F applies the chemical modifications described in FIG. 4A-F to an exemplary HCV siNA sequence. Such chemical modifications can be applied to any HCV sequence. Furthermore, the sequences shown in FIG. 5 can optionally include a ribonucleotide at the $9^{th}$ position from the 5'-end of the sense strand or the $11^{th}$ position based on the 5'-end of the guide strand by counting 11 nucleotide positions in from the 5'-terminus of the guide strand (see FIG. 6C). In addition, the sequences shown in FIG. 5 can optionally include terminal ribonucleotides at up to about 4 positions at the 5'-end of the antisense strand (e.g., about 1, 2, 3, or 4 terminal ribonucleotides at the 5'-end of the antisense strand) and/or cellular target sequence.

The 3'-ends of the Upper sequence and the Lower sequence of the siNA construct can include an overhang sequence, for example about 1, 2, 3, or 4 nucleotides in length, preferably 2 nucleotides in length, wherein the overhanging sequence of the lower sequence is optionally complementary to a portion of the target sequence. The upper sequence is also referred to as the sense strand, whereas the lower sequence is also referred to as the antisense strand. The upper and lower sequences in the Table can further comprise a chemical modification having Formulae I-VII, such as exemplary siNA constructs shown in FIGS. 4 and 5, or having modifications described in Table IV or any combination thereof.

TABLE III

HCV Synthetic Modified siNA Constructs

| Target Pos | Target | Seq ID | Cmpd# | Aliases | Sequence | Seq ID |
|---|---|---|---|---|---|---|
| 183 | GGUCCUUUCUUGGAUCAACCCGC | 1393 | 25237 | HCV IRES Loop IIIb (Heptazyme site) as siNA str1 (sense) | B GGUCCUUUCUUGGAUCAACCC B | 1467 |
| 183 | GGUCCUUUCUUGGAUCAACCCGC | 1393 | 25238 | HCV IRES Loop IIIb (Heptazyme site) as siNA str2 (antisense) | B GGGUUGAUCCAAGAAAGGACC B | 1468 |
| 183 | GGUCCUUUCUUGGAUCAACCCGC | 1393 | 25251 | HCV IRES Loop IIIb (Heptazyme site) as siNA str1 (sense) Inverted Control | B CCCAACUAGGUUCUUUCCUGG B | 1469 |
| 183 | GGUCCUUUCUUGGAUCAACCCGC | 1393 | 25252 | HCV IRES Loop IIIb (Heptazyme site) as siNA str1 (sense) Inverted Control Compliment | B CCAGGAAAGAACCUAGUUGGG B | 1470 |
| 183 | GGUCCUUUCUUGGAUCAACCCGC | 1393 | 25814 | HCV IRES Loop IIIb (Heptazyme site) as siNA str1 (sense) + 2U overhang | GGUCCUUUCUUGGAUCAACCCUU | 1471 |
| 183 | GGUCCUUUCUUGGAUCAACCCGC | 1393 | 25815 | HCV IRES Loop IIIb (Heptazyme site) as siNA str2 (antisense) + 2U overhang | GGGUUGAUCCAAGAAAGGACCUU | 1472 |
| 183 | GGUCCUUUCUUGGAUCAACCCGC | 1393 | 25834 | HCV IRES Loop IIIb (Heptazyme site) as siNA str1 (sense) + 2U overhang | BGGUCCUUUCUUGGAUCAACCCUUB | 1473 |
| 183 | GGUCCUUUCUUGGAUCAACCCGC | 1393 | 25835 | HCV IRES Loop IIIb (Heptazyme site) as siNA str2 (antisense) + 2U overhang | BGGGUUGAUCCAAGAAAGGACCUUB | 1474 |
| 325 | UGCCCCGGGAGGUCUCGUAGACC | 1394 | 28415 | HCVa:325U21 sense TT siNA | CCCCGGGAGGUCUCGUAGATT | 1475 |
| 162 | CGGAACCGGUGAGUACACC | 54 | 28416 | HCVa:162U21 sense TT siNA | CGGAACCGGUGAGUACACCTT | 1476 |
| 324 | GCCCCGGGAGGUCUCGUAG | 1 | 28417 | HCVa:324U21 sense TT siNA | GCCCCGGGAGGUCUCGUAGTT | 1477 |
| 163 | GGAACCGGUGAGUACACCG | 53 | 28418 | HCVa:163U21 sense TT siNA | GGAACCGGUGAGUACACCGTT | 1478 |
| 294 | GUGGUACUGCCUGAUAGGG | 5 | 28419 | HCVa:294U21 sense TT siNA | GUGGUACUGCCUGAUAGGGTT | 1479 |
| 293 | UGUGGUACUGCCUGAUAGG | 2 | 28420 | HCVa:293U21 sense TT siNA | UGUGGUACUGCCUGAUAGGTT | 1480 |
| 292 | UUGUGGUACUGCCUGAUAG | 3 | 28421 | HCVa:292U21 sense TT siNA | UUGUGGUACUGCCUGAUAGTT | 1481 |
| 325 | UGCCCCGGGAGGUCUCGUAGACC | 1394 | 28422 | HCVa:343L21 antisense TT siNA (325C) | UCUACGAGACCUCCCGGGGTT | 1482 |
| 162 | CGGAACCGGUGAGUACACC | 54 | 28423 | HCVa:180L21 antisense TT siNA (162C) | GGUGUACUCACCGGUUCCGTT | 1483 |
| 324 | GCCCCGGGAGGUCUCGUAG | 1 | 28424 | HCVa:342L21 antisense TT siNA (324C) | CUACGAGACCUCCCGGGGCTT | 1484 |
| 163 | GGAACCGGUGAGUACACCG | 53 | 28425 | HCVa:181L21 antisense TT siNA (163C) | CGGUGUACUCACCGGUUCCTT | 1485 |

TABLE III-continued

HCV Synthetic Modified siNA Constructs

| Target Pos | Target | Seq ID | Cmpd# | Aliases | Sequence | Seq ID |
|---|---|---|---|---|---|---|
| 294 | GUGGUACUGCCUGAUAGGG | 5 | 28426 | HCVa:312L21 antisense TT siNA (294C) | CCCUAUCAGGCAGUACCACTT | 1486 |
| 293 | UGUGGUACUGCCUGAUAGG | 2 | 28427 | HCVa:311L21 antisense TT siNA (293C) | CCUAUCAGGCAGUACCACATT | 1487 |
| 292 | UUGUGGUACUGCCUGAUAG | 3 | 28428 | HCVa:310L21 antisense TT siNA (292C) | CUAUCAGGCAGUACCACAATT | 1488 |
| 325 | UGCCCCGGGAGGUCUCGAUAGACC | 1394 | 28429 | HCVa:325U21 sense TT siNA inv | TTAGAUGCUCUGGAGGGCCCC | 1489 |
| 162 | CGGAACCGGUGAGUACACC | 54 | 28430 | HCVa:162U21 sense TT siNA inv | TTCCACAUGAGUGGCCAAGGC | 1490 |
| 324 | GCCCCGGGAGGUCUCGUAG | 1 | 28431 | HCVa:324U21 sense TT siNA inv | TTGAUGCUCUGGAGGGCCCCG | 1491 |
| 163 | GGAACCGGUGAGUACACCG | 53 | 28432 | HCVa:163U21 sense TT siNA inv | TTGCCACAUGAGUGGCCAAGG | 1492 |
| 294 | GUGGUACUGCCUGAUAGGG | 5 | 28433 | HCVa:294U21 sense TT siNA inv | TTGGGAUAGUCCGUCAUGGUG | 1493 |
| 293 | UGUGGUACUGCCUGAUAGG | 2 | 28434 | HCVa:293U21 sense TT siNA inv | TTGGAUAGUCCGUCAUGGUGU | 1494 |
| 292 | UUGUGGUACUGCCUGAUAG | 3 | 28435 | HCVa:292U21 sense TT siNA inv | TTGAUAGUCCGUCAUGGUGUU | 1495 |
| 325 | UGCCCCGGGAGGUCUCGAUAGACC | 1394 | 28436 | HCVa:343L21 antisense TT siNA (325C) inv | TTGGGGCCUCCAGAGCACUCU | 1496 |
| 162 | CGGAACCGGUGAGUACACC | 54 | 28437 | HCVa:180L21 antisense TT siNA (162C) inv | TTGCCUUGGCCACUCAUGUGG | 1497 |
| 324 | GCCCCGGGAGGUCUCGUAG | 1 | 28438 | HCVa:342L21 antisense TT siNA (324C) inv | TTCGGGGCCCUCCAGAGCAUC | 1498 |
| 163 | GGAACCGGUGAGUACACCG | 53 | 28439 | HCVa:181L21 antisense TT siNA (163C) inv | TTCCUUGGCCACUCAUGUGGC | 1499 |
| 294 | GUGGUACUGCCUGAUAGGG | 5 | 28440 | HCVa:312L21 antisense TT siNA (294C) inv | TTCACCAUGACGACUAUCCC | 1500 |
| 293 | UGUGGUACUGCCUGAUAGG | 2 | 28441 | HCVa:311L21 antisense TT siNA (293C) inv | TTACCAUGACGGACUAUCC | 1501 |
| 292 | UUGUGGUACUGCCUGAUAG | 3 | 28442 | HCVa:310L21 antisense TT siNA (292C) inv | TTAACACCAUGACGACUAUC | 1502 |
| 162 | CGGAACCGGUGAGUACACCGG | 1395 | 29573 | HCVa:162U21 sense siNA | CGGAACCGGUGAGUACACCGG | 1503 |
| 163 | GCGGAACCGGUGAGUACACCGA | 1396 | 29574 | HCVa:163U21 sense siNA | GGAACCGGUGAGUACACCGA | 1504 |
| 292 | CCUUGUGGUACUGCCUGAUAGGG | 1397 | 29575 | HCVa:292U21 sense siNA | UUGUGGUACUGCCUGAUAGG | 1505 |
| 293 | CUUGUGGUACUGCCUGAUAGGGU | 1398 | 29576 | HCVa:293U21 sense siNA | UGUGGUACUGCCUGAUAGGGU | 1506 |
| 294 | UUGUGGUACUGCCUGAUAGGGUG | 1399 | 29577 | HCVa:294U21 sense siNA | GUGGUACUGCCUGAUAGGGUG | 1507 |
| 324 | GUGCCCCGGGAGGUCUCGUAGAC | 1400 | 29578 | HCVa:324U21 sense siNA | GCCCCGGGAGGUCUCGUAGAC | 1508 |
| 325 | UGCCCCGGGAGGUCUCGUAGACC | 1394 | 29579 | HCVa:325U21 sense siNA | CCCCGGGAGGUCUCGUAGACC | 1509 |

TABLE III-continued

HCV Synthetic Modified siNA Constructs

| Target Pos | Target | Seq ID | Cmpd# | Aliases | Sequence | Seq ID |
|---|---|---|---|---|---|---|
| 162 | UGCGGAACCGGUGAGUACACCGG | 1395 | 29580 | HCVa:180L21 antisense siNA (162C) | GGUGUACUCACCGGUUCCGCA | 1510 |
| 163 | GCGGAACCGGUGAGUACACCGGA | 1396 | 29581 | HCVa:181L21 antisense siNA (163C) | CGGUGUACUCACCGGUUCCGC | 1511 |
| 292 | CCUUGUGGUACUGCCUGAUAGGG | 1397 | 29582 | HCVa:310L21 antisense siNA (292C) | CUAUCAGGCAGUACCACAAGG | 1512 |
| 293 | CUUGUGGUACUGCCUGAUAGGGU | 1398 | 29583 | HCVa:311L21 antisense siNA (293C) | CCUAUCAGGCAGUACCACAAG | 1513 |
| 294 | UUGUGGUACUGCCUGAUAGGGUG | 1399 | 29584 | HCVa:312L21 antisense siNA (294C) | CCCUAUCAGGCAGUACCACAA | 1514 |
| 324 | GUGCCCCGGGAGGUCUCGUAGAC | 1400 | 29585 | HCVa:342L21 antisense siNA (324C) | CUACGAGACCUCCCGGGGCAC | 1515 |
| 325 | UGCCCCGGGAGGUCUCGUAGACC | 1394 | 29586 | HCVa:343L21 antisense siNA (325C) | UCUACGAGACCUCCCGGGGCA | 1516 |
| 162 | UGCGGAACCGGUGAGUACACCGG | 1395 | 29587 | HCVa:162U21 sense siNA inv | GGCCACAUGAGUGGCCAAGGC | 1517 |
| 163 | GCGGAACCGGUGAGUACACCGGA | 1396 | 29588 | HCVa:163U21 sense siNA inv | AGGCCACAUGAGUGGCCAAGG | 1518 |
| 292 | CCUUGUGGUACUGCCUGAUAGGG | 1397 | 29589 | HCVa:292U21 sense siNA inv | GGGAUAGUCCGUCAUGGUGUU | 1519 |
| 293 | CUUGUGGUACUGCCUGAUAGGGU | 1398 | 29590 | HCVa:293U21 sense siNA inv | UGGGAUAGUCCGUCAUGGUGU | 1520 |
| 294 | UUGUGGUACUGCCUGAUAGGGUG | 1399 | 29591 | HCVa:294U21 sense siNA inv | GUGGGAUAGUCCGUCAUGGUG | 1521 |
| 324 | GUGCCCCGGGAGGUCUCGUAGAC | 1400 | 29592 | HCVa:324U21 sense siNA inv | CAGAUGCUCUGGAGGGCCCCG | 1522 |
| 325 | UGCCCCGGGAGGUCUCGUAGACC | 1394 | 29593 | HCVa:325U21 sense siNA inv | CCAGAUGCUCUGGAGGGCCCC | 1523 |
| 162 | UGCGGAACCGGUGAGUACACCGG | 1395 | 29594 | HCVa:180L21 antisense siNA (162C) inv | ACGCCUUGGCCACUCAUGUGG | 1524 |
| 163 | GCGGAACCGGUGAGUACACCGGA | 1396 | 29595 | HCVa:181L21 antisense siNA (163C) inv | CGCCUUGGCCACUCAUGUGGC | 1525 |
| 292 | CCUUGUGGUACUGCCUGAUAGGG | 1397 | 29596 | HCVa:310L21 antisense siNA (292C) inv | GGAACACCAUGACGGACUAUC | 1526 |
| 293 | CUUGUGGUACUGCCUGAUAGGGU | 1398 | 29597 | HCVa:311L21 antisense siNA (293C) inv | GAACACCAUGACGGACUAUCC | 1527 |
| 294 | UUGUGGUACUGCCUGAUAGGGUG | 1399 | 29598 | HCVa:312L21 antisense siNA (294C) inv | AACACCAUGACGGACUAUCCC | 1528 |
| 324 | GUGCCCCGGGAGGUCUCGUAGAC | 1400 | 29599 | HCVa:342L21 antisense siNA (324C) inv | CACGGGGCCCUCCAGAGCAUC | 1529 |
| 325 | UGCCCCGGGAGGUCUCGUAGACC | 1394 | 29600 | HCVa:343L21 antisense siNA (325C) inv | ACGGGGCCCUCCAGAGCAUCU | 1530 |
| 325 | UGCCCCGGGAGGUCUCGUAGACC | 1394 | 30051 | HCVa:325U21 sense siNA 5 5' P = S + 3' univ. base 2 + 5'/3' invAba | BCsCsCsCsGsGGAGGUCUCGUAGAXXB | 1531 |
| 325 | UGCCCCGGGAGGUCUCGUAGACC | 1394 | 30052 | HCVa:325U21 sense siNA inv 5 5' P = S + 3' univ. base 2 + 5'/3' invAba | BAsGsAsUsGsCUCUGGAGGGCCCCXXB | 1532 |

TABLE III-continued

HCV Synthetic Modified siNA Constructs

| Target Pos | Target | Seq ID | Cmpd# | Aliases | Sequence | Seq ID |
|---|---|---|---|---|---|---|
| 325 | UGCCCCGGGAGGUCUCGUAGACC | 1394 | 30053 | HCVa:343L21 antisense siNA (325C) 5 5' P = S + 3' univ. base 2 + 3' invAba | UsCsUsAsCsGAGACCUCCCGGGGXXB | 1533 |
| 325 | UGCCCCGGGAGGUCUCGUAGACC | 1394 | 30054 | HCVa:343L21 antisense siNA (325C) inv 5 5' P = S + 3' univ. base 2 + 3' invAba | GsGsGsGsCsCCUCCAGAGCAUCUXXB | 1534 |
| 325 | UGCCCCGGGAGGUCUCGUAGACC | 1394 | 30055 | HCVa:325U21 sense siNA all Y P = S + 3' univ. base 2 + 5'/3' invAba | BCsCsCsCsGGGAGGUsCsUsCsGUsAGAXXB | 1535 |
| 325 | UGCCCCGGGAGGUCUCGUAGACC | 1394 | 30056 | HCVa:325U21 sense siNA inv all Y P = S + 3' univ. base 2 + 5'/3' invAba | BAGAUsGCsUsCsUsGGAGGGCsCsCsCsXXB | 1536 |
| 325 | UGCCCCGGGAGGUCUCGUAGACC | 1394 | 30057 | HCVa:343L21 antisense siNA (325C) all Y P = S + 3' univ. base 2 + 3' invAba | UsCsUsACsGAGACsCsUsCsCsCsGGGGXXB | 1537 |
| 325 | UGCCCCGGGAGGUCUCGUAGACC | 1394 | 30058 | HCVa:343L21 antisense siNA (325C) inv all Y P = S + 3' univ. base 2 + 3' invAba | GGGGCsCsCsUsCsCsAGAGCsAUsCsUsXXB | 1538 |
| 325 | UGCCCCGGGAGGUCUCGUAGACC | 1394 | 30059 | HCVa:325U21 sense siNA 4/3 P = S ends + all Y-2'F + 3' univ. base 2 + 5'/3' invAba | BcscscscsGGGAGGucucGuAsGsAsXXB | 1539 |
| 325 | UGCCCCGGGAGGUCUCGUAGACC | 1394 | 30060 | HCVa:325U21 sense siNA inv 4/3 P = S ends + all Y-2'F + 3' univ. base 2 + 5'/3' invAba | BAsGsAsusGcucuGGAGGGccscscsXXB | 1540 |
| 325 | UGCCCCGGGAGGUCUCGUAGACC | 1394 | 30170 | HCVa:325U21 sense siNA all Y-2'F + 3' univ. base 2 + 5'/3' invAba | B ccccGGGAGGucucGuAGAXX B | 1541 |
| 325 | UGCCCCGGGAGGUCUCGUAGACC | 1394 | 30171 | HCVa:325U21 sense siNA inv all Y-2'F + 3' univ. base 2 + 5'/3' invAba | B AGAuGcucuGGAGGGccccXX B | 1542 |
| 325 | UGCCCCGGGAGGUCUCGUAGACC | 1394 | 30172 | HCVa:343L21 antisense siNA (325C) all Y P = S + 3' univ. base 2 + 5'/3' invAba | B UsCsUsACsGAGACsCsUsCsCsCsGGGGXX B | 1543 |
| 325 | UGCCCCGGGAGGUCUCGUAGACC | 1394 | 30173 | HCVa:343L19 antisense siNA (325C) all Y-2'F | ucuAcGAGAccucccGGGG | 1544 |
| 325 | UGCCCCGGGAGGUCUCGUAGACC | 1394 | 30175 | HCVa:343L21 antisense siNA (325C) all Y-2'F + 3' univ. Base 2 | ucuAcGAGAccucccGGGGXX | 1545 |
| 325 | UGCCCCGGGAGGUCUCGUAGACC | 1394 | 30176 | HCVa:343L21 antisense siNA (325C) inv all Y-2'F + 3' univ. Base 2 | GGGGcccuccAGAGcAucuXX | 1546 |
| 325 | UGCCCCGGGAGGUCUCGUAGACC | 1394 | 30177 | HCVa:343L21 antisense siNA (325C) all Y-2'F + 3' univ. Base 2 + 5'/3' iB | B ucuAcGAGAccucccGGGGXX B | 1547 |
| 325 | UGCCCCGGGAGGUCUCGUAGACC | 1394 | 30178 | HCVa:325U21 sense siNA all Y P = S + 3' univ. base 2 + 3' invAba | CsCsCsCsGGGAGGUsCsUsCsGUsAGAXX B | 1548 |

TABLE III-continued

HCV Synthetic Modified siNA Constructs

| Target Pos | Target | Seq ID | Cmpd# | Aliases | Sequence | Seq ID |
|---|---|---|---|---|---|---|
| 325 | UGCCCCGGGAGGUCUCGUAGACC | 1394 | 30417 | HCVa:325U21 sense siNA w/iB | CCCCGGGAGGUCUCGUAGACC B | 1549 |
| 325 | UGCCCCGGGAGGUCUCGUAGACC | 1394 | 30418 | HCVa:325U21 sense siNA w/iB | B CCCCGGGAGGUCUCGUAGACC B | 1550 |
| 325 | UGCCCCGGGAGGUCUCGUAGACC | 1394 | 30419 | HCVa:343L21 antisense siNA (325C) w/iB | UCUACGAGACCUCCCGGGGCA B | 1551 |
| 325 | UGCCCCGGGAGGUCUCGUAGACC | 1394 | 30420 | HCVa:343L21 antisense siNA (325C) w/iB | B UCUACGAGACCUCCCGGGGCA B | 1552 |
| 325 | UGCCCCGGGAGGUCUCGUAGACC | 1394 | 30561 | HCVa:325U21 sense siNA Y-2'Ome (stab06) + 5'/3' invAba | B ccccGGGAGGucucGuAGATT B | 1553 |
| 325 | UGCCCCGGGAGGUCUCGUAGACC | 1394 | 30562 | HCVa:343L21 antisense siNA (325C) Y-2'F, R-2'Ome + TsT | ucuAcGAGAccucccGGGGTsT | 1554 |
| 153 | AUAGUGGUCUGCGGAACCGGUGA | 1401 | 30649 | HCVa:153U21 sense siNA stab07 | B AGuGGucuGcGGAAccGGuTT B | 1555 |
| 159 | GUCUGCGGAACCGGUGAGUACAC | 1402 | 30650 | HCVa:159U21 sense siNA stab07 | B cuGcGGAAccGGuGAGuAcTT B | 1556 |
| 291 | GCCUUGUGGUACUGCCUGAUAGG | 1403 | 30651 | HCVa:291U21 sense siNA stab07 | B cuuGuGGuAcuGccuGAuATT B | 1557 |
| 295 | UGUGGUACUGCCUGAUAGGGUGC | 1404 | 30652 | HCVa:295U21 sense siNA stab07 | B uGGuAcuGccuGAuAGGGuTT B | 1558 |
| 296 | GUGGUACUGCCUGAUAGGGUGCU | 1405 | 30653 | HCVa:296U21 sense siNA stab07 | B GGuAcuGccuGAuAGGGuGTT B | 1559 |
| 297 | UGGUACUGCCUGAUAGGGUGCUU | 1406 | 30654 | HCVa:297U21 sense siNA stab07 | B GuAcuGccuGAuAGGGuGcTT B | 1560 |
| 298 | GGUACUGCCUGAUAGGGUGCUUG | 1407 | 30655 | HCVa:298U21 sense siNA stab07 | B uAcuGccuGAuAGGGuGcuTT B | 1561 |
| 300 | UACUGCCUGAUAGGGUGCUUGCG | 1408 | 30656 | HCVa:300U21 sense siNA stab07 | B cuGccuGAuAGGGuGcuuGTT B | 1562 |
| 301 | ACUGCCUGAUAGGGUGCUUGCGA | 1409 | 30657 | HCVa:301U21 sense siNA stab07 | B uGccuGAuAGGGuGcuuGcTT B | 1563 |
| 303 | UGCCUGAUAGGGUGCUUGCGAGU | 1410 | 30658 | HCVa:303U21 sense siNA stab07 | B ccuGAuAGGGuGcuuGcGATT B | 1564 |
| 306 | CUGAUAGGGUGCUUGCGAGUGCC | 1411 | 30659 | HCVa:306U21 sense siNA stab07 | B GAuAGGGuGcuuGcGAGuGTT B | 1565 |
| 324 | GUGCCCCGGGAGGUCUCGUAGAC | 1400 | 30660 | HCVa:324U21 sense siNA stab07 | B GccccGGGAGGucucGuAGTT B | 1566 |
| 153 | AUAGUGGUCUGCGGAACCGGUGA | 1401 | 30661 | HCVa:171L21 antisense siNA (153C) stab08 | AccGGuuccGcAGAccAcuTsT | 1567 |
| 159 | GUCUGCGGAACCGGUGAGUACAC | 1402 | 30662 | HCVa:177L21 antisense siNA (159C) stab08 | GuAcucAccGGuuccGcAGTsT | 1568 |
| 291 | GCCUUGUGGUACUGCCUGAUAGG | 1403 | 30663 | HCVa:309L21 antisense siNA (291C) stab08 | uAucAGGcAGuAccAcAAGTsT | 1569 |
| 295 | UGUGGUACUGCCUGAUAGGGUGC | 1404 | 30664 | HCVa:313L21 antisense siNA (295C) stab08 | AcccuAucAGGcAGuAccATsT | 1570 |
| 296 | GUGGUACUGCCUGAUAGGGUGCU | 1405 | 30665 | HCVa:314L21 antisense siNA (296C) stab08 | cAcccuAucAGGcAGuAccTsT | 1571 |

TABLE III-continued

| HCV Synthetic Modified siNA Constructs | | | | | | |
|---|---|---|---|---|---|---|
| Target Pos | Target | Seq ID | Cmpd# | Aliases | Sequence | Seq ID |
| 297 | UGGUACUGCCUGAUAGGGUGCUU | 1406 | 30666 | HCVa:315L21 antisense siNA (297C) stab08 | GcAcccuAucAGGcAGuAcTsT | 1572 |
| 298 | GGUACUGCCUGAUAGGGUGCUUG | 1407 | 30667 | HCVa:316L21 antisense siNA (298C) stab08 | AGcAcccuAucAGGcAGuATsT | 1573 |
| 300 | UACUGCCUGAUAGGGUGCUUGCG | 1408 | 30668 | HCVa:318L21 antisense siNA (300C) stab08 | cAAGcAcccuAucAGGcAGTsT | 1574 |
| 301 | ACUGCCUGAUAGGGUGCUUGCGA | 1409 | 30669 | HCVa:319L21 antisense siNA (301C) stab08 | GcAAGcAcccuAucAGGcATsT | 1575 |
| 303 | UGCCUGAUAGGGUGCUUGCGAGU | 1410 | 30670 | HCVa:321L21 antisense siNA (303C) stab08 | ucGcAAGcAcccuAucAGGTsT | 1576 |
| 306 | CUGAUAGGGUGCUUGCGAGUGCC | 1411 | 30671 | HCVa:324L21 antisense siNA (306C) stab08 | cAcucGcAAGcAcccuAucTsT | 1577 |
| 324 | GUGCCCCGGGAGGUCUCGUAGAC | 1400 | 30672 | HCVa:342L21 antisense siNA (324C) stab08 | cuAcGAGAccucccGGGGcTsT | 1578 |
| 153 | AUAGUGGUCUGCGGAACCGGUGA | 1401 | 30673 | HCVa:153U21 sense siNA stab07 inv | B uGGccAAGGcGucuGGuGATT B | 1579 |
| 159 | GUCUGCGGAACCGGUGAGUACAC | 1402 | 30674 | HCVa:159U21 sense siNA stab07 inv | B cAuGAGuGGccAAGGcGucTT B | 1580 |
| 291 | GCCUUGUGGUACUGCCUGAUAGG | 1403 | 30675 | HCVa:291U21 sense siNA stab07 inv | B AuAGuccGucAuGGuGuucTT B | 1581 |
| 295 | UGUGGUACUGCCUGAUAGGGUGC | 1404 | 30676 | HCVa:295U21 sense siNA stab07 inv | B uGGGAuAGuccGucAuGGuTT B | 1582 |
| 296 | GUGGUACUGCCUGAUAGGGUGCU | 1405 | 30677 | HCVa:296U21 sense siNA stab07 inv | B GuGGGAuAGuccGucAuGGTT B | 1583 |
| 297 | UGGUACUGCCUGAUAGGGUGCUU | 1406 | 30678 | HCVa:297U21 sense siNA stab07 inv | B cGuGGGAuAGuccGucAuGTT B | 1584 |
| 298 | GGUACUGCCUGAUAGGGUGCUUG | 1407 | 30679 | HCVa:298U21 sense siNA stab07 inv | B ucGuGGGAuAGuccGucAuTT B | 1585 |
| 300 | UACUGCCUGAUAGGGUGCUUGCG | 1408 | 30680 | HCVa:300U21 sense siNA stab07 inv | B GuucGuGGGAuAGuccGucTT B | 1586 |
| 301 | ACUGCCUGAUAGGGUGCUUGCGA | 1409 | 30681 | HCVa:301U21 sense siNA stab07 inv | B cGuucGuGGGAuAGuccGuTT B | 1587 |
| 303 | UGCCUGAUAGGGUGCUUGCGAGU | 1410 | 30682 | HCVa:303U21 sense siNA stab07 inv | B AGcGuucGuGGGAuAGuccTT B | 1588 |
| 306 | CUGAUAGGGUGCUUGCGAGUGCC | 1411 | 30683 | HCVa:306U21 sense siNA stab07 inv | B GuGAGcGuucGuGGGAuAGTT B | 1589 |
| 324 | GUGCCCCGGGAGGUCUCGUAGAC | 1400 | 30684 | HCVa:324U21 sense siNA stab07 inv | B GAuGcucuGGAGGGccccGTT B | 1590 |
| 153 | AUAGUGGUCUGCGGAACCGGUGA | 1401 | 30685 | HCVa:171L21 antisense siNA (153C) stab08 inv | ucAccAGAcGccuuGGccATsT | 1591 |
| 159 | GUCUGCGGAACCGGUGAGUACAC | 1402 | 30686 | HCVa:177L21 antisense siNA (159C) stab08 inv | GacGccuuGGccAcucAuGTsT | 1592 |
| 291 | GCCUUGUGGUACUGCCUGAUAGG | 1403 | 30687 | HCVa:309L21 antisense siNA (291C) stab08 inv | GAAcAccAuGAcGGAcuAuTsT | 1593 |
| 295 | UGUGGUACUGCCUGAUAGGGUGC | 1404 | 30688 | HCVa:313L21 antisense siNA (295C) stab08 inv | AccAuGAcGGAcuAucccATsT | 1594 |
| 296 | GUGGUACUGCCUGAUAGGGUGCU | 1405 | 30689 | HCVa:314L21 antisense siNA (296C) stab08 inv | ccAuGAcGGAcuAucccAcTsT | 1595 |

TABLE III-continued

HCV Synthetic Modified siNA Constructs

| Target Pos | Target | Seq ID | Cmpd# | Aliases | Sequence | Seq ID |
|---|---|---|---|---|---|---|
| 297 | UGGUACUGCCUGAUAGGGUGCUU | 1406 | 30690 | HCVa:315L21 antisense siNA (297C) stab08 inv | cAuGAcGGAcuAucccAcGTsT | 1596 |
| 298 | GGUACUGCCUGAUAGGGUGCUUG | 1407 | 30691 | HCVa:316L21 antisense siNA (298C) stab08 inv | AuGAcGGAcuAucccAcGATsT | 1597 |
| 300 | UACUGCCUGAUAGGGUGCUUGCG | 1408 | 30692 | HCVa:318L21 antisense siNA (300C) stab08 inv | GAcGGAcuAucccAcGAAcTsT | 1598 |
| 301 | ACUGCCUGAUAGGGUGCUUGCGA | 1409 | 30693 | HCVa:319L21 antisense siNA (301C) stab08 inv | AcGGAcuAucccAcGAAcGTsT | 1599 |
| 303 | UGCCUGAUAGGGUGCUUGCGAGU | 1410 | 30694 | HCVa:321L21 antisense siNA (303C) stab08 inv | GGAcuAucccAcGAAcGcuTsT | 1600 |
| 306 | CUGAUAGGGUGCUUGCGAGUGCC | 1411 | 30695 | HCVa:324L21 antisense siNA (306C) stab08 inv | cuAucccAcGAAcGcucAcTsT | 1601 |
| 324 | GUGCCCCGGGAGGUCUCGUAGAC | 1400 | 30696 | HCVa:342L21 antisense siNA (324C) stab08 inv | cGGGGcccuccAGAGcAucTsT | 1602 |
| 325 | UGCCCCGGGAGGUCUCGUAGACC | 1394 | 31340 | HCVa:325U21 sense siNA stab04 | B ccccGGGAGGucucGuAGATT B | 1603 |
| 325 | UGCCCCGGGAGGUCUCGUAGACC | 1394 | 31341 | HCVa:325U21 sense siNA inv stab04 | B AGAuGcucuGGAGGGccccTT B | 1604 |
| 325 | UGCCCCGGGAGGUCUCGUAGACC | 1394 | 31342 | HCVa:343L21 antisense siNA (325C) stab05 | ucuAcGAGAccucccGGGGTsT | 1605 |
| 325 | UGCCCCGGGAGGUCUCGUAGACC | 1394 | 31343 | HCVa:343L21 antisense siNA (325C) inv stab05 | GGGGcccuccAGAGcAucuTsT | 1606 |
| 325 | UGCCCCGGGAGGUCUCGUAGACC | 1394 | 31344 | HCVa:325U21 sense siNA stab07 | B cccc*GGGAGG*ucuc*G*u*AGA*TT B | 1607 |
| 325 | UGCCCCGGGAGGUCUCGUAGACC | 1394 | 31345 | HCVa:325U21 sense siNA inv stab07 | B AGAuGcucuGGAGGGccccTT B | 1608 |
| 325 | UGCCCCGGGAGGUCUCGUAGACC | 1394 | 31346 | HCVa:343L21 antisense siNA (325C) inv stab08 | GGGGcccuccAGAGcAucuTsT | 1609 |
| 325 | UGCCCCGGGAGGUCUCGUAGACC | 1394 | 31347 | HCVa:343L21 antisense siNA (325C) stab11 | ucuAcGAGAccucccGGGGTsT | 1610 |
| 325 | UGCCCCGGGAGGUCUCGUAGACC | 1394 | 31348 | HCVa:343L21 antisense siNA (325C) inv stab11 | *GGGG*cccucc*AGAG*cAucuTsT | 1611 |
| 153 | AUAGUGGUCUGCGGAACCGGUGA | 1401 | 31453 | HCVa:153U21 sense siNA stab04 | B AGuGGucuGcGGAAccGGuTT B | 1612 |
| 159 | GUCUGCGGAACCGGUGAGUACAC | 1402 | 31454 | HCVa:159U21 sense siNA stab04 | B cuGcGGAAccGGuGAGuAcTT B | 1613 |
| 287 | AAAGGCCUUGUGGUACUGCCUGA | 1412 | 31455 | HCVa:287U21 sense siNA stab04 | B AGGccuuGuGGuAcuGccuTT B | 1614 |
| 291 | GCCUUGUGGUACUGCCUGAUAGG | 1403 | 31456 | HCVa:291U21 sense siNA stab04 | B cuuGuGGuAcuGccuGAuATT B | 1615 |
| 295 | UGUGGUACUGCCUGAUAGGGUGC | 1404 | 31457 | HCVa:295U21 sense siNA stab04 | B uGGuAcuGccuGAuAGGGuTT B | 1616 |
| 296 | GUGGUACUGCCUGAUAGGGUGCU | 1405 | 31458 | HCVa:296U21 sense siNA stab04 | B GGuAcuGccuGAuAGGGuGTT B | 1617 |
| 297 | UGGUACUGCCUGAUAGGGUGCUU | 1406 | 31459 | HCVa:297U21 sense siNA stab04 | B GuAcuGccuGAuAGGGuGcTT B | 1618 |
| 298 | GGUACUGCCUGAUAGGGUGCUUG | 1407 | 31460 | HCVa:298U21 sense siNA stab04 | B uAcuGccuGAuAGGGuGcuTT B | 1619 |

TABLE III-continued

HCV Synthetic Modified siNA Constructs

| Target Pos | Target | Seq ID | Cmpd# | Aliases | Sequence | Seq ID |
|---|---|---|---|---|---|---|
| 300 | UACUGCCUGAUAGGGUGCUUGCG | 1408 | 31461 | HCVa:300U21 sense siNA stab04 | B cuGccGAuAGGGuGCuuGcuuGTT B | 1620 |
| 301 | ACUGCCUGAUAGGGUGCUUGCGA | 1409 | 31462 | HCVa:301U21 sense siNA stab04 | B uGccGAuAGGGuGCuuGcuuGcTT B | 1621 |
| 303 | UGCCUGAUAGGGUGCUUGCGAGU | 1410 | 31463 | HCVa:303U21 sense siNA stab04 | B ccuGAuAGGGuGCuuGcuuGcGATT B | 1622 |
| 306 | CUGAUAGGGUGCUUGCGAGUGCC | 1411 | 31464 | HCVa:306U21 sense siNA stab04 | B GAuAGGGuGCuuGcGAGuGTT B | 1623 |
| 153 | AUAGUGGUCUGCGAACCGGUGA | 1401 | 31465 | HCVa:171L21 antisense siNA (153C) stab05 | AccGGuucGcAGAccAcuTsT | 1624 |
| 159 | GUCUGCGGAACCGGUGAGUACAC | 1402 | 31466 | HCVa:177L21 antisense siNA (159C) stab05 | GuAcucAccGGuuccGcAGTsT | 1625 |
| 287 | AAAGGCCUUGUGGUACUGCCUGA | 1412 | 31467 | HCVa:305L21 antisense siNA (287C) stab05 | AGGcAGuAccAcAAGGccuTsT | 1626 |
| 291 | GCCUUGUGGUACUGCCUGAUAGG | 1403 | 31468 | HCVa:309L21 antisense siNA (291C) stab05 | uAucAGGcAGuAccAcAAGTsT | 1627 |
| 295 | UGUGGUACUGCCUGAUAGGGUGC | 1404 | 31469 | HCVa:313L21 antisense siNA (295C) stab05 | AccGuAucAGGcAGuAccATsT | 1628 |
| 296 | GUGGUACUGCCUGAUAGGGUGCU | 1405 | 31470 | HCVa:314L21 antisense siNA (296C) stab05 | cAccuAucAGGcAGuAccTsT | 1629 |
| 297 | UGGUACUGCCUGAUAGGGUGCUU | 1406 | 31471 | HCVa:315L21 antisense siNA (297C) stab05 | GcAccuAucAGGcAGuAcTsT | 1630 |
| 298 | GGUACUGCCUGAUAGGGUGCUUG | 1407 | 31472 | HCVa:316L21 antisense siNA (298C) stab05 | AGcAccuAucAGGcAGuATsT | 1631 |
| 300 | UACUGCCUGAUAGGGUGCUUGCG | 1408 | 31473 | HCVa:318L21 antisense siNA (300C) stab05 | cAAGcAccuAucAGGcAGTsT | 1632 |
| 301 | ACUGCCUGAUAGGGUGCUUGCGA | 1409 | 31474 | HCVa:319L21 antisense siNA (301C) stab05 | GcAAGcAccuAucAGGcATsT | 1633 |
| 303 | UGCCUGAUAGGGUGCUUGCGAGU | 1410 | 31475 | HCVa:321L21 antisense siNA (303C) stab05 | ucGcAAGcAccuAucAGTsT | 1634 |
| 306 | CUGAUAGGGUGCUUGCGAGUGCC | 1411 | 31476 | HCVa:324L21 antisense siNA (306C) stab05 | cAcucGcAAGcAccuAucTsT | 1635 |
| 153 | AUAGUGGUCUGCGAACCGGUGA | 1401 | 31477 | HCVa:153U21 sense siNA inv stab04 | B uGGccAAGGcGucuGGuGATT B | 1636 |
| 159 | GUCUGCGGAACCGGUGAGUACAC | 1402 | 31478 | HCVa:159U21 sense siNA inv stab04 | B cAuGAGuGGccAAGGcGucTT B | 1637 |
| 287 | AAAGGCCUUGUGGUACUGCCUGA | 1412 | 31479 | HCVa:287U21 sense siNA inv stab04 | B uccGucAuGGuGuuccGGATT B | 1638 |
| 291 | GCCUUGUGGUACUGCCUGAUAGG | 1403 | 31480 | HCVa:291U21 sense siNA inv stab04 | B AuAGucGucAuGGuGuuccTT B | 1639 |
| 295 | UGUGGUACUGCCUGAUAGGGUGC | 1404 | 31481 | HCVa:295U21 sense siNA inv stab04 | B uGGGAuAGucGucAuGGuTT B | 1640 |
| 296 | GUGGUACUGCCUGAUAGGGUGCU | 1405 | 31482 | HCVa:296U21 sense siNA inv stab04 | B GuGGGAuAGucGucAuGGTT B | 1641 |
| 297 | UGGUACUGCCUGAUAGGGUGCUU | 1406 | 31483 | HCVa:297U21 sense siNA inv stab04 | B cGuGGGAuAGucGucAuGTT B | 1642 |
| 298 | GGUACUGCCUGAUAGGGUGCUUG | 1407 | 31484 | HCVa:298U21 sense siNA inv stab04 | B ucGuGGGAuAGucGucAuTT B | 1643 |

TABLE III-continued

| HCV Synthetic Modified siNA Constructs | | | | | | |
|---|---|---|---|---|---|---|
| Target Pos | Target | Seq ID | Cmpd# | Aliases | Sequence | Seq ID |
| 300 | UACUGCCUGAUAGGGUGCUUGCG | 1408 | 31485 | HCVa:300U21 sense siNA inv stab04 | B GuucGuGGGAuAGuccGucTT B | 1644 |
| 301 | ACUGCCUGAUAGGGUGCUUGCGA | 1409 | 31486 | HCVa:301U21 sense siNA inv stab04 | B cGuucGuGGGAuAGuccGuTT B | 1645 |
| 303 | UGCCUGAUAGGGUGCUUGCGAGU | 1410 | 31487 | HCVa:303U21 sense siNA inv stab04 | B AGcGuucGuGGGAuAGuccTT B | 1646 |
| 306 | CUGAUAGGGUGCUUGCGAGUGCC | 1411 | 31488 | HCVa:306U21 sense siNA inv stab04 | B GuGAGcGuucGuGGGAuAGTT B | 1647 |
| 153 | AUAGUGGUCUGCGGAACCGGUGA | 1401 | 31489 | HCVa:171L21 antisense siNA (153C) inv stab05 | ucAccAGAcGccuuGGccATsT | 1648 |
| 159 | GUCUGCGGAACCGGUGAGUACAC | 1402 | 31490 | HCVa:177L21 antisense siNA (159C) inv stab05 | GacGccuuGGccAcucAuGTsT | 1649 |
| 287 | AAAGGCCUUGUGGUACUGCCUGA | 1412 | 31491 | HCVa:305L21 antisense siNA (287C) inv stab05 | uccGGAAcAccAuGAcGGATsT | 1650 |
| 291 | GCCUUGUGGUACUGCCUGAUAGG | 1403 | 31492 | HCVa:309L21 antisense siNA (291C) inv stab05 | GAAcAccAuGAcGGAcuAuTsT | 1651 |
| 295 | UGUGGUACUGCCUGAUAGGGUGC | 1404 | 31493 | HCVa:313L21 antisense siNA (295C) inv stab05 | AccAuGAcGGAcuAucccATsT | 1652 |
| 296 | GUGGUACUGCCUGAUAGGGUGCU | 1405 | 31494 | HCVa:314L21 antisense siNA (296C) inv stab05 | ccAuGAcGGAcuAucccAcTsT | 1653 |
| 297 | UGGUACUGCCUGAUAGGGUGCUU | 1406 | 31495 | HCVa:315L21 antisense siNA (297C) inv stab05 | cAuGAcGGAcuAucccAcGTsT | 1654 |
| 298 | GGUACUGCCUGAUAGGGUGCUUG | 1407 | 31496 | HCVa:316L21 antisense siNA (298C) inv stab05 | AuGAcGGAcuAucccAcGATsT | 1655 |
| 300 | UACUGCCuGAUAGGGUGCUUGCG | 1408 | 31497 | HCVa:318L21 antisense siNA (300C) inv stab05 | GAcGGAcuAucccAcGAAcTsT | 1656 |
| 301 | ACUGCCUGAUAGGGUGCUUGCGA | 1409 | 31498 | HCVa:319L21 antisense siNA (301C) inv stab05 | AcGGAcuAucccAcGAAcGTsT | 1657 |
| 303 | UGCCUGAUAGGGUGCUUGCGAGU | 1410 | 31499 | HCVa:321L21 antisense siNA (303C) inv stab05 | GGAcuAucccAcGAAcGcuTsT | 1658 |
| 306 | CUGAUAGGGUGCUUGCGAGUGCC | 1411 | 31500 | HCVa:324L21 antisense siNA (306C) inv stab05 | cuAucccAcGAAcGcucAcTsT | 1659 |
| 190 | GGGUCCUUUCUUGGAUCAACCCG | 1413 | 31659 | HCVb:190U21 sense siNA stab04 | B GuccuuucuuGGAucAAccTT B | 1660 |
| 191 | GGUCCUUUCUUGGAUCAACCCGC | 1393 | 31660 | HCVb:191U21 sense siNA stab04 | B uccuuucuuGGAucAAcccTT B | 1661 |

TABLE III-continued

HCV Synthetic Modified siNA Constructs

| Target Pos | Target | Seq ID | Cmpd# | Aliases | Sequence | Seq ID |
|---|---|---|---|---|---|---|
| 189 | CGGGUCCUUUCUUGGAUCAACCC | 1414 | 31661 | HCVb:189U21 sense siNA stab04 | B GGuccuuucuuGGAucAAcTT B | 1662 |
| 186 | GACCGGGUCCUUUCUUGGAUCAA | 1415 | 31662 | HCVb:186U21 sense siNA stab04 | B ccGGGuccuuucuuGGAucTT B | 1663 |
| 190 | GGGUCCUUUCUUGGAUCAACCCG | 1413 | 31663 | HCVb:208L21 antisense siNA (190C) stab05 | GGuuGAuccAAGAAAGGAcTsT | 1664 |
| 191 | GGUCCUUUCUUGGAUCAACCCGC | 1393 | 31664 | HCVb:209L21 antisense siNA (191C) stab05 | GGGuuGAuccAAGAAAGGATsT | 1665 |
| 189 | CGGGUCCUUUCUUGGAUCAACCC | 1414 | 31665 | HGVb:207L21 antisense siNA (189C) stab05 | GuuGAuccAAGAAAGGAccTsT | 1666 |
| 186 | GACCGGGUCCUUUCUUGGAUCAA | 1415 | 31666 | HCVb:204L21 antisense siNA (186C) stab05 | GAuccAAGAAAGGAcccGGTsT | 1667 |
| 190 | GGGUCCUUUCUUGGAUCAACCCG | 1413 | 31667 | HCVb:190U21 sense siNA inv stab04 | B ccAAcuAGGuucuuuccuGTT B | 1668 |
| 191 | GGUCCUUUCUUGGAUCAACCCGC | 1393 | 31668 | HCVb:191U21 sense siNA inv stab04 | B cccAAcuAGGuucuuuccuTT B | 1669 |
| 189 | CGGGUCCUUUCUUGGAUCAACCC | 1414 | 31669 | HCVb:189U21 sense siNA inv stab04 | B cAAcuAGGuucuuuccuGGTT B | 1670 |
| 186 | GACCGGGUCCUUUCUUGGAUCAA | 1415 | 31670 | HCVb:186U21 sense siNA inv stab04 | B cuAGGuucuuuccuGGGccTT B | 1671 |
| 190 | GGGUCCUUUCUUGGAUCAACCCG | 1413 | 31671 | HCVb:208L21 antisense siNA (190C) inv stab05 | cAGGAAAGAAccuAGuuGGTsT | 1672 |
| 191 | GGUCCUUUCUUGGAUCAACCCGC | 1393 | 31672 | HCVb:209L21 antisense siNA (191C) inv stab05 | AGGAAAGAAccuAGuuGGGTsT | 1673 |
| 189 | CGGGUCCUUUCUUGGAUCAACCC | 1414 | 31673 | HCVb:207L21 antisense siNA (189C) inv stab05 | ccAGGAAAGAAccuAGuuGTsT | 1674 |
| 186 | GACCGGGUCCUUUCUUGGAUCAA | 1415 | 31674 | HCVb:204L21 antisense siNA (186C) inv stab05 | GGcccAGGAAAGAAccuAGTsT | 1675 |
| 326 | GCCCCGGGAGGUCUCGUAGACCG | 1416 | 31702 | HCVa:326U21 sense siNA stab07 | B cccGGGAGGucucGuAGAcTT B | 1676 |
| 327 | CCCCGGGAGGUCUCGUAGACCGU | 1417 | 31703 | HCVa:327U21 sense siNA stab07 | B ccGGGAGGucucGuAGAccTT B | 1677 |
| 328 | CCCGGGAGGUCUCGUAGACCGUG | 1418 | 31704 | HCVa:328U21 sense siNA stab07 | B cGGGAGGucucGuAGAccGTT B | 1678 |
| 329 | CCGGGAGGUCUCGUAGACCGUGC | 1419 | 31705 | HCVa:329U21 sense siNA stab07 | B GGGAGGucucGuAGAccGuTT B | 1679 |
| 326 | GCCCCGGGAGGUCUCGUAGACCG | 1416 | 31706 | HCVa:344L21 antisense siNA (326C) stab08 | GucuAcGAGAccucccGGGTsT | 1680 |
| 327 | CCCCGGGAGGUCUCGUAGACCGU | 1417 | 31707 | HCVa:345L21 antisense siNA (327C) stab08 | GGucuAcGAGAccucccGGTsT | 1681 |

TABLE III-continued

HCV Synthetic Modified siNA Constructs

| Target Pos | Target | Seq ID | Cmpd# | Aliases | Sequence | Seq ID |
|---|---|---|---|---|---|---|
| 328 | CCCGGGAGGUCUCGUAGACCGUG | 1418 | 31708 | HCVa:346L21 antisense siNA (328C) stab08 | cGGucuAcGAGAccuccccGTsT | 1682 |
| 329 | CCGGGAGGUCUCGUAGACCGUGC | 1419 | 31709 | HCVa:347L21 antisense siNA (329C) stab08 | AcGGucuAcGAGAccuccccTsT | 1683 |
| 326 | GCCCCGGGAGGUCUCGUAGACCG | 1416 | 31710 | HCVa:326U21 sense siNA inv stab07 | B cAGAuGcucuGGAGGGcccTT B | 1684 |
| 327 | CCCCGGGAGGUCUGGUAGACCGU | 1417 | 31711 | HCVa:327U21 sense siNA inv stab07 | B ccAGAuGcucuGCAGGGccTT B | 1685 |
| 328 | CCCGGGAGGUCUCGUAGACCGUG | 1418 | 31712 | HCVa:328U21 sense siNA inv stab07 | B GccAGAuGcucuGGAGGGcTT B | 1686 |
| 329 | CCGGGAGGUCUCGUAGACCGUGC | 1419 | 31713 | HCVa:329U21 sense siNA inv stab07 | B uGccAGAuGCucuGGAGGGTT B | 1687 |
| 326 | GCCCCGGGAGGUCUCGUAGACCG | 1416 | 31714 | HCVa:344L21 antisense siNA (326C) inv stab08 | GGGcccuccAGAGcAucuGTsT | 1688 |
| 327 | CCCCGGGAGGUCUCGUAGACGGU | 1417 | 31715 | HCVa:345L21 antisense siNA (327C) inv stab08 | GGcccuccAGAGcAucuGGTsT | 1689 |
| 328 | CCCGGGAGGUCUCGUAGACCGUG | 1418 | 31716 | HCVa:346L21 antisense siNA (328C) inv stab08 | GcccuccAGAGcAucuGGcTsT | 1690 |
| 329 | CCGGGAGGUCUCGUAGACCGUGC | 1419 | 31717 | HCVa:347L21 antisense siNA (329C) inv stab08 | cccuccAGAGcAucuGGcATsT | 1691 |
| 291 | GCCUUGUGGUACUGCCUGAUAGG | 1403 | 31762 | HCVa:291U21 sense siNA stab08 | cuuGuGGuAcuGccuGAuATsT | 1692 |
| 295 | UGUGGUACUGCCUGAUAGGGUGC | 1404 | 31763 | HCVa:295U21 sense siNA stab08 | uGGuAcuGccuGAuAGGGuTsT | 1693 |
| 325 | UGCCCCGGGAGGUCUGGUAGACC | 1394 | 31764 | HCVa:325U21 sense siNA stab08 | ccccGGGAGGucucGuAGATsT | 1694 |
| 291 | GCCUUGUGGUACUGCCUGAUAGG | 1403 | 31765 | HCVa:291U21 sense siNA inv stab08 | AuAGuccGucAuGGuGuucTsT | 1695 |
| 295 | UGUGGUACUGCCUGAUAGGGUGC | 1404 | 31766 | HCVa:295U21 sense siNA inv stab08 | uGGGAuAGuccGucAuGGuTsT | 1696 |
| 325 | UGCCCCGGGAGGUCUCGUAGACC | 1394 | 31767 | HCVa:325U21 sense siNA inv stab08 | AGAuGcucuGGAGGGccccTsT | 1697 |
| 327 | CCCCGGGAGGUCUCGUAGAGCGU | 1417 | 31928 | HCVa:327U21 sense siNA stab08 | ccGGGAGGucucGuAGAccTsT | 1698 |
| 327 | CCCCGGGAGGUCUCGUAGACCGU | 1417 | 31929 | HCVa:327U21 sense siNA inv stab08 | ccAGAuGcucuGGAGGGccTsT | 1699 |
| 328 | CCCGGGAGGUCUCGUAGACCGUG | 1418 | 31930 | HCVa:328U21 sense siNA stab08 | cGGGAGGucucGuAGAccGTsT | 1700 |
| 328 | CCCGGGAGGUCUCGUAGACCGUG | 1418 | 31931 | HCVa:328U21 sense siNA inv stab08 | GccAGAuGcucuGGAGGGcTsT | 1701 |
| 327 | CCCGGGGAGGUCUCGUAGACCGU | 1417 | 32007 | HCVa:327U21 sense siNA stab08 + 5' abasic | B ccGGGAGGucucGuAGAccTsT | 1702 |
| 327 | CCCCGGGAGGUCUCGUAGACCGU | 1417 | 32008 | HCVa:327U21 sense siNA stab08 + 3' abasic | ccGGGAGGucucGuAGAccTsT B | 1703 |

TABLE III-continued

HCV Synthetic Modified siNA Constructs

| Target Pos | Target | Seq ID | Cmpd# | Aliases | Sequence | Seq ID |
|---|---|---|---|---|---|---|
| 327 | CCCCGGGAGGUCUCGUAGACCGU | 1417 | 32009 | HCVa:327U21 sense siNA stab08 + 5' 3' abasic | B ccGGGAGucucGuAGAccTsT B | 1704 |
| 327 | CCCCGGGAGGUCUCGUAGACCGU | 1417 | 32174 | HCVa:327 siNA 3'-class1 10bp | UCUCGUAGACCUU GGUCUACGAGACCUCCCGUTT | 1705 |
| 327 | CCCCGGGAGGUCUCGUAGACCGU | 1417 | 32175 | HCVa:327 siNA 3'-class1 18bp | UCGUAGACCUU GGUCUACGAGACCUCCCGUTT | 1706 |
| 327 | CCCCGGGAGGUCUCGUAGACCGU | 1417 | 32176 | HCVa:327 siNA 3'-class1 6bp | GUAGACCUU GGUCUACGAGACCUCCCGGTT | 1707 |
| 327 | CCCCGGGAGGUCUCGUAGACCGU | 1417 | 32177 | HCVa:327 siNA 3-class1 4bp | AGACCUU GGUCUACGAGACCUCCCGGTT | 1708 |
| 327 | CCCCGGGAGGUCUCGUAGACCGU | 1417 | 32178 | HCVa:327siNA 5'-class1 10bp | GGUCUACGAGACCUCCCGGUU CCGGAGGUGU | 1709 |
| 327 | CCCCGGGAGGUCUCGUAGACCGU | 1417 | 32179 | HCVa:327 siNA 5'-class1 8bp | GGUCUACGAGACCUCCCGGUU CCGGAGGU | 1710 |
| 327 | CCCCGGGAGGUCUCGUAGACCGU | 1417 | 32180 | HCVa:327 siNA 5'-class1 6bp | GGUCUACGAGACCUCCCGGUU CCGGAG | 1711 |
| 327 | CCCCGGGAGGUCUCGUAGACCGU | 1417 | 32181 | HCVa:327 siNA 5'-classI 4bp | GGUCUACGAGACCUCCCGGUU CCGGG | 1712 |
| 327 | CCCCGGGAGGUCUCGUAGACCGU | 1417 | 32182 | HCVa:327 siNA 3'-gaaa 10bp | CUCGUAGACC GAAA GGUCUACGAGACCUCCCGGTT | 1713 |
| 327 | CCCCGGGAGGUCUCGUAGACCGU | 1417 | 32183 | HCVa:327 siNA 3'-gaaa 8bp | CGUAGACC GAAA GGUCUACGAGACCUCCCGGTT | 1714 |
| 327 | CCCCGGGAGGUCUCGUAGACCGU | 1417 | 32184 | HCVa:327 siNA 3'-gaaa 6bp | UAGACC GAAA GGUCUACGAGACCUCCCGGTT | 1715 |
| 327 | CCCCGGGAGGUCUCGUAGACCGU | 1417 | 32185 | HCVa:327 siNA 3'-gaaa 4bp | GACC GAAA GGUCUACGAGACCUCCCGGTT | 1716 |
| 327 | CCCCGGGAGGUCUCGUAGACCGU | 1417 | 32186 | HCVa:327 siNA 5'-gaaa 10bp | GGUCUACGAGACCUCCCGGUU GAAA CCGGAGGUC | 1717 |
| 327 | CCCCGGGAGGUCUCGUAGACCGU | 1417 | 32187 | HCVa:327 siNA 5'-gaaa 8bp | GGUCUACGAGACCUCCCGGUU GAAA CCGGAGG | 1718 |
| 327 | CCCCGGGAGGUCUCGUAGACCGU | 1417 | 32188 | HCVa:327 siNA 5'-gaaa 6bp | GGUCUACGAGACCUCCCGGUU GAAA CCGGA | 1719 |
| 327 | CCCCGGGAGGUCUCGUAGACCGU | 1417 | 32189 | HCVa:327 siNA 5'-gaaa 4bp | GGUCUACGAGACCUCCCGGUU GAAA CCGG | 1720 |
| 327 | CCCCGGGAGGUCUCGUAGACCGU | 1417 | 32190 | HCVa:327 siNA 3'-uuuguguag 10bp | CGUAGACCUU UUUGUGUAG GGUCUACGAGACCUCCCGGTT | 1721 |

TABLE III-continued

HCV Synthetic Modified siNA Constructs

| Target Pos | Target | Seq ID | Cmpd# | Aliases | Sequence | Seq ID |
|---|---|---|---|---|---|---|
| 327 | CCCCGGGAGGUCUCGUAGACCGU | 1417 | 32191 | HCVa:327 siNA 3'-uuuguguag 8bp | UAGACCUU UUUGUGUAG GGUCUACGAGACCUCCCGGTT | 1722 |
| 327 | CCCCGGGAGGUCUCGUAGACCGU | 1417 | 32192 | HCVa:327 siNA 3'-uuuguguag 6bp | GACCUU UUUGUGUAG GGUCUACGAGACCUCCCGGTT | 1723 |
| 327 | CCCCGGGAGGUCUCGUAGACCGU | 1417 | 32193 | HCVa:327 siNA 3'-uuuguguag 4bp | CCUU UUUGUGUAG GGUCUACGAGACCUCCCGGTT | 1724 |
| 327 | CCCCGGGAGGUCUCGUAGACCGU | 1417 | 32194 | HCVa:327 siNA 5'-uuuguguag 10bp | GGUCUACGAGACCUCCCGGUU UUUGUGUAG CCGGGAGGUC | 1725 |
| 327 | CCCCGGGAGGUCUCGUAGACCGU | 1417 | 32195 | HCVa:327 siNA 5'-uuuguguag 8bp | GGUCUACGAGACCUCCCGGUU UUUGUGUAG CCGGGAGG | 1726 |
| 327 | CCCCGGGAGGUCUCGUAGACCGU | 1417 | 32196 | HCVa:327 siNA 5'-uuuguguag 6bp | GGUCUACGAGACCUCCCGGUU UUUGUGUAG CCGGGA | 1727 |
| 327 | CCCCGGGAGGUCUCGUAGACCGU | 1417 | 32197 | HCVa:327 siNA 5'-uuuguguag 4bp | GGUCUACGAGACCUCCCGGUU UUUGUGUAG CCGG | 1728 |
| 327 | CCCCGGGAGGUCUCGUAGACCGU | 1417 | 32198 | HCVa:345L21 antisense (327C) stab05 siNA | GGucuAcGAGAccucccGGTsT | 1729 |
| 327 | CCCCGGGAGGUCUCGUAGACCGU | 1417 | 32199 | HCVa:345L21 antisense (327C) stab05 5'p siNA | pGGucuAcGAGAccucccGGTsT | 1730 |
| 327 | CCCCGGGAGGUCUCGUAGACCGU | 1417 | 32200 | HCVa:345L21 antisense (327C) stab05 5'ps siNA | sGGucuAcGAGAccucccGGTsT | 1731 |
| 327 | CCCCGGGAGGUCUCGUAGACCGU | 1417 | 32201 | HCVa:345L21 antisense (327C) stab00 siNA | GGUCUACGAGACCUCCCGGTT | 1732 |
| 327 | CCCCGGGAGGUCUCGUAGACCGU | 1417 | 32202 | HCVa:345L21 antisense (327C) v1 5'p siNA | pGGUCUACGAGACCUCCCGGTT | 1733 |
| 327 | CCCCGGGAGGUCUCGUAGACCGU | 1417 | 32203 | HCVa:345L21 antisense (327C) v1 5'ps siNA | sGGUCUACGAGACCUCCCGGTT | 1734 |
| 327 | CCCCGGGAGGUCUCGUAGACCGU | 1417 | 32204 | HCVa:345L21 antisense (327C) v2 5'p siNA | pGGUCUACGAGACCUCCCGGGGTT | 1735 |
| 327 | CCCCGGGAGGUCUCGUAGACCGU | 1417 | 32205 | HCVa:345L21 antisense (327C) v3 5'p siNA | pGGUCUACGAGACCUCCCGG UCUCGUA u B | 1736 |
| 327 | CCCCGGGAGGUCUCGUAGACCGU | 1417 | 32206 | HCVa:345L21 antisense (327C) v4 5'p siNA | pGGUCUACGAGACCUCCCGG AGGUCUCGUA uu B | 1737 |

TABLE III-continued

HCV Synthetic Modified siNA Constructs

| Target Pos | Target | Seq ID | Cmpd# | Aliases | Sequence | Seq ID |
|---|---|---|---|---|---|---|
| 327 | CCCCGGAGGUCUCGUAGACCGU | 1417 | 32207 | HCVa:345L21 antisense (327C) v5 5'p siNA | pGGUCUACGAGACCUCCCGGUU UCUCGUA u B | 1738 |
| 327 | CCCCGGAGGUCUCGUAGACCGU | 1417 | 32208 | HCVa:345L21 antisense (327C) v6 5'p siNA | pGGUCUACGAGACCUCCCGGUU AGGUCUGUA u B | 1739 |
| 327 | CCCCGGAGGUCUCGUAGACCGU | 1417 | 32501 | HCVa:327U21 sense siNA stab04 | B ccGGGAGGucucGuAGAccTT | 1740 |
| 325 | UGCCCCGGAGGUCUCGUAGACC | 1394 | 32502 | HCVa:325U21 sense siNA stab09 | B CCCCGGAGGUCUCGUAGAUT B | 1741 |
| 326 | GCCCCGGAGGUCUCGUAGACCG | 1416 | 32503 | HCVa:326U21 sense siNA stab09 | B CCCGGAGGUCUCGUAGACUU B | 1742 |
| 327 | CCCCGGAGGUCUCGUAGACCGU | 1417 | 32504 | HCVa:327U21 sense siNA stab09 | B CCGGAGGUCUCGUAGACCUU B | 1743 |
| 328 | CCCGGAGGUCUCGUAGACCGUG | 1418 | 32505 | HCVa:328U21 sense siNA stab09 | B CGGAGGUCUCGUAGACCGUU B | 1744 |
| 329 | CCGGAGGUCUCGUAGACCGUGC | 1419 | 32506 | HCVa:329U21 sense siNA stab09 | B GGGAGGUCUCGUAGACCGUU B | 1745 |
| 325 | UGCCCCGGAGGUCUCGUAGACC | 1394 | 32507 | HCVa:343L21 antisense siNA (325C) stab10 | UCUACGAGACCUCCCGGGTsT | 1746 |
| 326 | GCCCCGGAGGUCUCGUAGACCG | 1416 | 32508 | HCVa:344L21 antisense siNA (326C) stab10 | GUCUACGAGACCUCCGGTsT | 1747 |
| 327 | CCCCGGAGGUCUCGUAGACCGU | 1417 | 32509 | HCVa:345L21 antisense siNA (327C) stab10 | GGUCUACGAGACCUCCCGTsT | 1748 |
| 328 | CCCGGAGGUCUCGUAGACCGUG | 1418 | 32510 | HCVa:346L21 antisense siNA (328C) stab10 | CGGUCUACGAGACCCCCGTsT | 1749 |
| 329 | CCGGAGGUCUCGUAGACCGUGC | 1419 | 32511 | HCVa:347L21 antisense siNA (329C) stab10 | ACGGUCUACGAGACCUCCCTsT | 1750 |
| 327 | CCCCGGAGGUCUCGUAGACCGU | 1417 | 32512 | HCVa:327U21 sense siNA inv stab04 | B ccAGAuGcucuGGAGGccTT | 1751 |
| 327 | CCCCGGAGGUCUCGUAGACCGU | 1417 | 32513 | HCVa:345L21 antisense siNA (327C) inv stab05 | GGcccuccAGAGcAucuGGTsT | 1752 |
| 325 | UGCCCCGGAGGUCUCGUAGACC | 1394 | 32514 | HCVa:325U21 sense siNA inv stab09 | B AGAUGCUCUGGAGGGGCCTT B | 1753 |
| 326 | GCCCCGGAGGUCUCGUAGACCG | 1416 | 32515 | HCVa:326U21 sense siNA inv stab09 | B CAGAUGCUCUGGAGGGCCCTT B | 1754 |
| 327 | CCCCGGAGGUCUCGUAGACCGU | 1417 | 32516 | HCVa:327U21 sense siNA inv stab09 | B CCAGAUGCUCUGGAGGGCCTT B | 1755 |
| 328 | CCCGGAGGUCUCGUAGACCGUG | 1418 | 32517 | HCVa:328U21 sense siNA inv stab09 | B GCCAGAUGCUCUGGAGGGCTT B | 1756 |
| 329 | CCGGAGGUCUCGUAGACCGUGC | 1419 | 32518 | HCVa:329U21 sense siNA inv stab09 | B UGCCAGAUGCUCUGGAGGGTT B | 1757 |

TABLE III-continued

HCV Synthetic Modified siNA Constructs

| Target Pos | Target | Seq ID | Cmpd# | Aliases | Sequence | Seq ID |
|---|---|---|---|---|---|---|
| 325 | UGCCCCGGGAGGUCUCGUAGACC | 1394 | 32519 | HCVa:343L21 antisense siNA (325C) inv stab10 | GGGGCCCUCCAGAGCAUCUTsT | 1758 |
| 326 | GCCCCGGGAGGUCUCGUAGACCG | 1416 | 32520 | HCVa:344L21 antisense siNA (326C) inv stab10 | GGGCCCUCCAGAGCAUCUGTsT | 1759 |
| 327 | CCCCGGGAGGUCUCGUAGACCGU | 1417 | 32521 | HCVa:345L21 antisense siNA (327C) inv stab10 | GGCCCUCCAGAGCAUCUGGTsT | 1760 |
| 328 | CCCGGGAGGUCUCGUAGACCGUG | 1418 | 32522 | HCVa:346L21 antisense siNA (328C) inv stab10 | GCCCUCCAGAGCAUCUGGCTsT | 1761 |
| 329 | CCGGGAGGUCUCGUAGACCGUGC | 1419 | 32523 | HCVa:347L21 antisense siNA (329C) inv stab10 | CCCUCCAGAGCAUCUGGCATsT | 1762 |
| 295 | UGUGGUACUGCCUGAUAGGGUGC | 1404 | 32714 | HCVa:313L21 antisense siNA (295C) v1 5'p palindrome | pACCUAUCAGGCAGUACCA GUACUGCCUGAU B | 1763 |
| 295 | UGUGGUACUGCCUGAUAGGGUGC | 1404 | 32715 | HCVa:313L21 antisense siNA (295C) v2 5'p palindrome | pACCUAUCAGGCAGUACC GGUACUGCCUGAU B | 1764 |
| 327 | CCCCGGGAGGUCUCGUAGACCGU | 1417 | 32716 | HCVa:5'p-345L21 antisense siNA v5 5'p palindrome | pGG TABLE III-continued HCV Synthetic Modified siNA Constructs

| Target Pos | Target | Seq ID | Cmpd# | Aliases | Sequence | Seq ID |
|---|---|---|---|---|---|---|
| 154 | UAGUGGUCUGCGGAACCGGUGAG | 1423 | 33128 | HCVa:154U21 sense siNA stab07 | B GuGGucuGcGGAAccGGuGTT B | 1775 |
| 155 | AGUGGUCUGCGGAACCGGUGAGU | 1424 | 33129 | HCVa:155U21 sense siNA stab07 | B uGGucuGcGGAAccGGuGATT B | 1776 |
| 156 | GUGGUCUGCGGAACCGGUGAGUA | 1425 | 33130 | HCVa:156U21 sense siNA stab07 | B GGucuGcGGAAccGGuGAGTT B | 1777 |
| 157 | UGGUCUGCGGAACCGGUGAGUAC | 1426 | 33131 | HCVa:157U21 sense siNA stab07 | B GucuGcGGAAccGGuGAGuTT B | 1778 |
| 158 | GGUCUGCGGAACCGGUGAGUACA | 1427 | 33132 | HCVa:158U21 sense siNA stab07 | B ucuGcGGAAccGGuGAGuATT B | 1779 |
| 160 | UCUGCGGAACCGGUGAGUACACC | 1428 | 33133 | HCVa:160U21 sense siNA stab07 | B uGcGGAAccGGuGAGuAcATT B | 1780 |
| 161 | CUGCGGAACCGGUGAGUACACCG | 1429 | 33134 | HCVa:161U21 sense siNA stab07 | B GcGGAAccGGuGAGuAcAcTT B | 1781 |
| 164 | CGGAACCGGUGAGUACACCGGAA | 1430 | 33135 | HCVa:164U21 sense siNA stab07 | B GAAccGGuGAGuAcAccGGTT B | 1782 |
| 165 | GGAACCGGUGAGUACACCGGAAU | 1431 | 33136 | HCVa:165U21 sense siNA stab07 | B AAccGGuGAGuAcAccGGATT B | 1783 |
| 166 | GAACCGGUGAGUACACCGGAAUU | 1432 | 33137 | HCVa:166U21 sense siNA stab07 | B AccGGuGAGuAcAccGGAATT B | 1784 |
| 167 | AACCGGUGAGUACACCGGAAUUG | 1433 | 33138 | HCVa:167U21 sense siNA stab07 | B ccGGuGAGuAcAccGGAAuTT B | 1785 |
| 282 | UCGCGAAAGGCCUUGUGGUACUG | 1434 | 33139 | HCVa:282U21 sense siNA stab07 | B GcGAAAGGccuuGuGGuAcuTT B | 1786 |
| 283 | CGCGAAAGGCCUUGUGGUACUGC | 1435 | 33140 | HCVa:283U21 sense siNA stab07 | B cGAAAGGccuuGuGGuAcuGTT B | 1787 |
| 284 | GCGAAAGGCCUUGUGGUACUGCC | 1436 | 33141 | HCVa:284U21 sense siNA stab07 | B GAAAGGccuuGuGGuAcuGcTT B | 1788 |
| 285 | CGAAAGGCCUUGUGGUACUGCCU | 1437 | 33142 | HCVa:285U21 sense siNA stab07 | B AAAGGccuuGuGGuAcuGccTT B | 1789 |
| 286 | GAAAGGCCUUGUGGUACUGCCUG | 1438 | 33143 | HCVa:286U21 sense siNA stab07 | B AAGGccuuGuGGuAcuGccuTT B | 1790 |
| 288 | AAGGCCUUGUGGUACUGCCUGAU | 1439 | 33144 | HCVa:288U21 sense siNA stab07 | B GGccuuGuGGuAcuGccuGATT B | 1791 |
| 289 | AGGCCUUGUGGUACUGCCUGAUA | 1440 | 33145 | HCVa:289U21 sense siNA stab07 | B GccuuGuGGuAcuGccuGAuTT B | 1792 |
| 290 | GGCCUUGUGGUACUGCCUGAUAG | 1441 | 33146 | HCVa:290U21 sense siNA stab07 | B ccuuGuGGuAcuGccuGAuATT B | 1793 |
| 299 | GUACUGCCUGAUAGGGUGCUUGC | 1442 | 33147 | HCVa:299U21 sense siNA stab07 | B AcuGccuGAuAGGGuGcuuTT B | 1794 |
| 302 | CUGCCUGAUAGGGUGCUUGCGAG | 1443 | 33148 | HCVa:302U21 sense siNA stab07 | B GccuGAuAGGGuGcuuGcGTT B | 1795 |
| 304 | GCCUGAUAGGGUGCUUGCGAGUG | 1444 | 33149 | HCVa:304U21 sense siNA stab07 | B cuGAuAGGGuGcuuGcGAGTT B | 1796 |
| 305 | CCUGAUAGGGUGCUUGCGAGUGC | 1445 | 33150 | HCVa:305U21 sense siNA stab07 | B uGAuAGGGuGcuuGcGAGuTT B | 1797 |
| 307 | UGAUAGGGUGCUUGCGAGUGCCC | 1446 | 33151 | HCVa:307U21 sense siNA stab07 | B AuAGGGuGcuuGcGAGuGcTT B | 1798 |

TABLE III-continued

HCV Synthetic Modified siNA Constructs

| Target Pos | Target | Seq ID | Cmpd# | Aliases | Sequence | Seq ID |
|---|---|---|---|---|---|---|
| 308 | GAUAGGGUGCUUGCGAGUGCCCC | 1447 | 33152 | HCVa:308U21 sense siNA stab07 | B uAGGGuGcuuGcGAGuGccGuTT B | 1799 |
| 310 | UAGGGUGCUUGCGAGUGCCCCGG | 1448 | 33153 | HCVa:310U21 sense siNA stab07 | B GGGuGcuuGcGAGuGccccGuTT B | 1800 |
| 311 | AGGGUGCUUGCGAGUGCCCCGGG | 1449 | 33154 | HCVa:311U21 sense siNA stab07 | B GGuGcuuGcGAGuGccccGGTTB | 1801 |
| 314 | GUGCUUGCGAGUGCCCCGGGAGG | 1450 | 33155 | HCVa:314U21 sense siNA stab07 | B GcuuGcGAGuGccccGGGATT B | 1802 |
| 315 | UGCUUGCGAGUGCCCCGGGAGGU | 1451 | 33156 | HCVa:315U21 sense siNA stab07 | B cuuGcGAGuGccccGGGAGTT B | 1803 |
| 316 | GCUUGCGAGUGCCCCGGGAGGUC | 1452 | 33157 | HCVa:316U21 sense siNA stab07 | B uuGcGAGuGccccGGGAGGTT B | 1804 |
| 317 | CUUGCGAGUGCCCCGGGAGGUCU | 1453 | 33158 | HCVa:317U21 sense siNA stab07 | B uGcGAGuGccccGGGAGGuTT B | 1805 |
| 318 | UUGCGAGUGCCCCGGGAGGUCUC | 1454 | 33159 | HCVa:318U21 sense siNA stab07 | B GcGAGuGccccGGGAGGucTT B | 1806 |
| 319 | UGCGAGUGCCCCGGGAGGUCUCG | 1455 | 33160 | HCVa:319U21 sense siNA stab07 | B cGAGuGccccGGGAGGucuTT B | 1807 |
| 320 | GCGAGUGCCCCGGGAGGUCUCGU | 1456 | 33161 | HCVa:320U21 sense siNA stab07 | B GAGuGccccGGGAGGucucTT B | 1808 |
| 322 | GAGUGCCCCGGGAGGUCUCGUAG | 1457 | 33162 | HCVa:322U21 sense siNA stab07 | B GuGccccGGGAGGucucGuTT B | 1809 |
| 323 | AGUGCCCCGGGAGGUCUCGUAGA | 1458 | 33163 | HCVa:323U21 sense siNA stab07 | B uGccccGGGAGGucucGuATT B | 1810 |
| 330 | CGGGAGGUCUCGUAGACCGUGCA | 1459 | 33164 | HCVa:330U21 sense siNA stab07 | B GGAGGucucGuAGAccGuGTT B | 1811 |
| 140 | UCCCGGAGAGCCAUAGUGGUCUG | 1420 | 33165 | HCVa:158L21 antisense siNA (140C) stab08 | AcuAcuAuGcucuccGTsT | 1812 |
| 141 | CCCGGAGAGCCAUAGUGGUCUGG | 1421 | 33166 | HCVa:159L21 antisense siNA (141C) stab08 | GaccAcuAuGGcucuccGTsT | 1813 |
| 142 | CCGGAGAGCCAUAGUGGUCUGCG | 1422 | 33167 | HCVa:160L21 antisense siNA (142C) stab08 | AGAccAcuAuGGcucuccTsT | 1814 |
| 154 | UAGUGGUCUGCGGAACCGGUGAG | 1423 | 33168 | HCVa:172L21 antisense siNA (154C) stab08 | cAccGGuuccGcAGAccAcTsT | 1815 |
| 155 | AGUGGUCUGCGGAACCGGUGAGU | 1424 | 33169 | HCVa:173L21 antisense siNA (155C) stab08 | ucAccGGuuccGcAGAccATsT | 1816 |
| 156 | GUGGUCUGCGGAACCGGUGAGUA | 1425 | 33170 | HCVa:174L21 antisense siNA (156C) stab08 | cucAccGGuuccGcAGAccTsT | 1817 |
| 157 | UGGUCUGCGGAACCGGUGAGUAC | 1426 | 33171 | HCVa:175L21 antisense siNA (157C) stab08 | AcucAccGGuuccGcAGAcTsT | 1818 |
| 158 | GGUCUGCGGAACCGGUGAGUACA | 1427 | 33172 | HCVa:176L21 antisense siNA (158C) stab08 | uAcucAccGGuuccGcAGATsT | 1819 |
| 160 | UCUGCGGAACCGGUGAGUACACC | 1428 | 33173 | HCVa:178L21 antisense siNA (160C) stab08 | uGuAcucAccGGuuccGcATsT | 1820 |
| 161 | CUGCGGAACCGGUGAGUACACCG | 1429 | 33174 | HCVa:179L21 antisense siNA (161C) stab08 | GuGuAcucAccGGuuccGcTsT | 1821 |
| 164 | CGGAACCGGUGAGUACACCGGAA | 1430 | 33175 | HCVa:182L21 antisense siNA (164C) stab08 | ccGGuGuAcucAccGGuucTsT | 1822 |
| 165 | GGAACCGGUGAGUACACCGGAAU | 1431 | 33176 | HCVa:183L21 antisense siNA (165C) stab08 | uccGGuGuAcucAccGGuuTsT | 1823 |

TABLE III-continued

HCV Synthetic Modified siNA Constructs

| Target Pos | Target | Seq ID | Cmpd# | Aliases | | Sequence | Seq ID |
|---|---|---|---|---|---|---|---|
| 166 | GAACCGGUGAGUACACCGGAAUU | 1432 | 33177 | HCVa:184L21 antisense siNA (166C) | stab08 | uuccGGuGuAcucAccGGuTsT | 1824 |
| 167 | AACCGGUGAGUACACCGGAAUUG | 1433 | 33178 | HCVa:185L21 antisense siNA (167C) | stab08 | AuuccGGuGuAcucAccGGTsT | 1825 |
| 282 | UCGCGAAAGGCCUUGUGGUACUG | 1434 | 33179 | HCVa:300L21 antisense siNA (282C) | stab08 | GuAccAcAAGGccuuucGcTsT | 1826 |
| 283 | CGCGAAAGGCCUUGUGGUACUGC | 1435 | 33180 | HCVa:301L21 antisense siNA (283C) | stab08 | AGuAccAcAAGGccuuucGTsT | 1827 |
| 284 | GCGAAAGGCCUUGUGGUACUGCC | 1436 | 33181 | HCVa:302L21 antisense siNA (284C) | stab08 | cAGuAccAcAAGGccuuucTsT | 1828 |
| 285 | CGAAAGGCCUUGUGGUACUGCCU | 1437 | 33182 | HCVa:303L21 antisense siNA (285C) | | GcAGuAccAcAAGGccuuuTsT | 1829 |
| 286 | GAAAGGCCUUGUGGUACUGCCUG | 1438 | 33183 | HCVa:304L21 antisense siNA (286C) | stab08 | GGcAGuAccAcAAGGcccuTsT | 1830 |
| 288 | AAGGCCUUGUGGUACUGCCUGAU | 1439 | 33184 | HCVa:306L21 antisense siNA (288C) | stab08 | cAGGcAGuAccAcAAGGccTsT | 1831 |
| 289 | AGGCCUUGUGGUACUGCCUGAUA | 1440 | 33185 | HCVa:307L21 antisense siNA (289C) | stab08 | ucAGGcAGuAccAcAAGGcTsT | 1832 |
| 290 | GGCCUUGUGGUACUGCCUGAUAG | 1441 | 33186 | HCVa:308L21 antisense siNA (290C) | stab08 | AucAGGcAGuAccAcAAGGTsT | 1833 |
| 299 | GUACUGCCUGAUAGGGUGCUUGC | 1442 | 33187 | HCVa:317L21 antisense siNA (299C) | stab08 | AAGcAcccuAucAGGcAGTsT | 1834 |
| 302 | CUGCCUGAUAGGGUGCUUGCGAG | 1443 | 33188 | HCVa:320L21 antisense siNA (302C) | stab08 | cGcAAGcAcccuAucAGGcTsT | 1835 |
| 304 | GCCUGAUAGGGUGCUUGCGAGUG | 1444 | 33189 | HCVa:322L21 antisense siNA (304C) | stab08 | cucGcAAGcAcccuAucAGTsT | 1836 |
| 305 | CCUGAUAGGGUGCUUGCGAGUGC | 1445 | 33190 | HCVa:323L21 antisense siNA (305C) | stab08 | AcucGcAAGcAcccuAucATsT | 1837 |
| 307 | UGAUAGGGUGCUUGCGAGUGCCC | 1446 | 33191 | HCVa:325L21 antisense siNA (307C) | stab08 | GcAcucGcAAGcAcccuAuTsT | 1838 |
| 308 | GAUAGGGUGCUUGCGAGUGCCCC | 1447 | 33192 | HCVa:326L21 antisense siNA (308C) | stab08 | GGcAcucGcAAGcAcccuATsT | 1839 |
| 310 | UAGGGUGCUUGCGAGUGCCCCGG | 1448 | 33193 | HCVa:328L21 antisense siNA (310C) | stab08 | GGGGcAcucGcAAGcAcccTsT | 1840 |
| 311 | AGGGUGCUUGCGAGUGCCCCGGG | 1449 | 33194 | HCVa:329L21 antisense siNA (311C) | stab08 | cGGGGcAcucGcAAGcAccTsT | 1841 |
| 314 | GUGCUUGCGAGUGCCCCGGGAGG | 1450 | 33195 | HCVa:332L21 antisense siNA (314C) | stab08 | uccCGGGGcAcucGcAAGcTsT | 1842 |
| 315 | UGCUUGCGAGUGCCCCGGGAGGU | 1451 | 33196 | HCVa:333L21 antisense siNA (315C) | stab08 | cuccCGGGGcAcucGcAAGTsT | 1843 |
| 316 | GCUUGCGAGUGCCCCGGGAGGUC | 1452 | 33197 | HCVa:334L21 antisense siNA (316C) | stab08 | ccuccCGGGGcAcucGcAATsT | 1844 |
| 317 | CUUGCGAGUGCCCCGGGAGGUCU | 1453 | 33198 | HCVa:335L21 antisense siNA (317C) | stab08 | AccuccCGGGGcAcucGcATsT | 1845 |
| 318 | UUGCGAGUGCCCCGGGAGGUCUC | 1454 | 33199 | HCVa:336L21 antisense siNA (318C) | stab08 | GAccuccCGGGGcAcucGcTsT | 1846 |
| 319 | UGCGAGUGCCCCGGGAGGUCUCG | 1455 | 33200 | HCVa:337L21 antisense siNA (319C) | stab08 | GAcuccCGGGGcAcucGTsT | 1847 |

TABLE III-continued

HCV Synthetic Modified siNA Constructs

| Target Pos | Target | Seq ID | Cmpd# | Aliases | Sequence | Seq ID |
|---|---|---|---|---|---|---|
| 320 | GCGAGUGCCCCGGGAGGUCUCGU | 1456 | 33201 | HCVa:338L21 antisense siNA (320C) stab08 | GAGAccuccCGGGGcAcucTsT | 1848 |
| 322 | GAGUGCCCCGGGAGGUCUCGUAG | 1457 | 33202 | HCVa:340L21 antisense siNA (322C) stab08 | AcGAGAccuccCGGGGcAcTsT | 1849 |
| 323 | AGUGCCCCGGGAGGUCUCGUAGA | 1458 | 33203 | HCVa:341L21 antisense siNA (323C) stab08 | uAcGAGAccuccCGGGGcATsT | 1850 |
| 330 | CGGGAGGUCUCGUAGACCGUGCA | 1459 | 33204 | HCVa:348L21 antisense siNA (330C) stab08 | cAcGucuAcGAGAccuccTsT | 1851 |
| 303 | UGCCUGAUAGGGUGCUUGCGAGU | 1410 | 33329 | HCVa:321L21 antisense siNA (303C) stab08 + 5' P | pucGcAAGcAcccuAucAGGTsT | 1852 |
| 303 | UGCCUGAUAGGGUGCUUGCGAGU | 1410 | 33330 | HCVa:321L21 antisense siNA (303C) stab08 + 5' P | pucGcAAGcAcccuAucAGGTsT | 1853 |
| 295 | UGUGGUACUGCCUGAUAGGGUGC | 1404 | 33331 | HCVa:313L21 antisense siNA (295C) stab08 + 5' P | pAcccuAucAGGcAGuAccATsT | 1854 |
| 295 | UGUGGUACUGCCUGAUAGGGUGC | 1404 | 33332 | HCVa:313L21 antisense siNA (295C) stab08 + 5' P | pAcccuAucAGGcAGuAccATsT | 1855 |
| 306 | CUGAUAGGGUGCUUGCGAGUGCC | 1411 | 33333 | HCVa:324L21 antisense siNA (306C) stab08 + 5' P | pcAcucGcAAGcAcccuAucTsT | 1856 |
| 327 | CCCCGGGAGGUCUCGUAGACCGU | 1417 | 33334 | HCVa:345L21 antisense siNA (327C) stab08 + 5' P | pGGucuAcGAGAccuccCGGTsT | 1857 |
| 303 | UGCCUGAUAGGGUGCUUGCGAGU | 1410 | 33346 | HCVa:321L21 antisense siNA (303C) stab08 + 5' aminoL | L ucGcAAGcAcccuAucAGGTsT | 1858 |
| 303 | UGCCUGAUAGGGUGCUUGCGAGU | 1410 | 33347 | HCVa:321L21 antisense siNA (303C) stab08 + 5' aminoL | L ucGcAAGcAcccuAucAGGTsT | 1859 |
| 295 | UGUGGUACUGCCUGAUAGGGUGC | 1404 | 33348 | HCVa:313L21 antisense siNA (295C) stab05 + 5' aminoL | L AcccuAucAGGcAGuAccATsT | 1860 |
| 295 | UGUGGUACUGCCUGAUAGGGUGC | 1404 | 33349 | HCVa:313L21 antisense siNA (295C) stab05 + 5' aminoL | L AcccuAucAGGcAGuAccATsT | 1861 |
| 306 | CUGAUAGGGUGCUUGCGAGUGCC | 1411 | 33350 | HCVa:324L21 antisense siNA (306C) stab08 + 5' aminoL | L cAcucGcAAGcAcccuAucTsT | 1862 |
| 327 | CCCCGGGAGGUCUCGUAGACCGU | 1417 | 33351 | HCVa:345L21 antisense siNA (327C) stab08 + 5' aminoL | L GGucuAcGAGAccuccCGGTsT | 1863 |
| 327 | CCCCGGGAGGUCUCGUAGACCGU | 1417 | 34024 | HCVa:327U21 sense siNA inact1 stab07 | B ccGAGAGucGGuAGuccTT B | 1864 |
| 327 | CCCCGGGAGGUCUCGUAGACGGU | 1417 | 34025 | HCVa:327U21 sense siNA inact2 stab07 | B ccGAGAGGucGcGucGAucTT B | 1865 |

TABLE III-continued

HCV Synthetic Modified siNA Constructs

| Target Pos | Target | Seq ID | Cmpd# | Aliases | Sequence | Seq ID |
|---|---|---|---|---|---|---|
| 327 | CCCCGGGAGGUCUCGUAGACCGU | 1417 | 34026 | HCVa:327U21 sense siNA inact3 stab07 | B ccGGuAGGucccGuGGAcATT | 1866 |
| 327 | CCCCGGGAGGUCUCGUAGACCGU | 1417 | 34027 | HCVa:345L21 antisense siNA (327C) inact1 stab08 | GGAcuAcGcGAccucucGGTsT | 1867 |
| 327 | CCCCGGGAGGUCUCGUAGACCGU | 1417 | 34028 | HCVa:345L21 antisense siNA (327C) inact2 stab08 | GAucGAcGcGAccucucGGTsT | 1868 |
| 327 | CCCCGGGAGGUCUCGUAGACCGU | 1417 | 34029 | HCVa:345L21 antisense siNA (327C) inact3 stab08 | uGuccAcGGGAccuAccGGTsT | 1869 |
| 282 | UCGCGAAAGGCCUUGUGGUACUG | 1434 | 34030 | HCVa:282U21 sense siNA inact1 stab07 | B GcuAAAGcGuuGuGGcAcTT | 1870 |
| 282 | UCGCGAAAGGCCUUGUGGUACUG | 1434 | 34031 | HCVa:282U21 sense siNA inact2 stab07 | B GcGuAAGGcccuGuGGuAATT | 1871 |
| 282 | UCGCGAAAGGCCUUGUGGUACUG | 1434 | 34032 | HCVa:282U21 sense siNA inact3 stab07 | B GAGAAAccccuGGuGGuucTT | 1872 |
| 283 | CGCGAAAGGCCUUGUGGUACUGC | 1435 | 34033 | HCVa:283U21 sense siNA inact1 stab07 | B cGuAAGGcAuuGuGGcAcuTT | 1873 |
| 283 | CGCGAAAGGCCUUGUGGUACUGC | 1435 | 34034 | HCVa:283U21 sense siNA inact2 stab07 | B cGAGAGGcAuuGuGcuAcuTT | 1874 |
| 283 | CGCGAAAGGCCUUGUGGUACUGC | 1435 | 34035 | HCVa:283U21 sense siNA inact3 stab07 | B ccAAAGGucuuGAGGuGcuTT | 1875 |
| 304 | GCCUGAUAGGGUGCUUGCGAGUG | 1444 | 34036 | HCVa:304U21 sense siNA inact1 stab07 | B cGGAuAGGccuuGuGuGAGTT | 1876 |
| 304 | GCCUGAUAGGGUGCUUGCGAGUG | 1444 | 34037 | HCVa:304U21 sense siNA inact2 stab07 | B cuGcuAGGGuAcuuGGGAGTT | 1877 |
| 304 | GCCUGAUAGGGUGCUUGCGAGUG | 1444 | 34038 | HCVa:304U21 sense siNA inact3 stab07 | B ccGAuAuGGuGAuuGcGGGTT | 1878 |
| 307 | UGAUAGGGUGCUUGCGAGUGCCC | 1446 | 34039 | HCVa:307U21 sense siNA inact1 stab07 | B AuuGGGuccuGGcGAGuAcTT | 1879 |
| 307 | UGAUAGGGUGCUUGCGAGUGCCC | 1446 | 34040 | HCVa:307U21 sense siNA inact2 stab07 | B AuAuGGGucccuGcGAGuGGTT | 1880 |
| 307 | UGAUAGGGUGCUUGCGAGUGCCC | 1446 | 34041 | HCVa:307U21 sense siNA inact3 stab07 | B AGAGGGuAcuuGcGcGuGuTT | 1881 |

TABLE III-continued

HCV Synthetic Modified siNA Constructs

| Target Pos | Target | Seq ID | Cmpd# | Aliases | Sequence | Seq ID |
|---|---|---|---|---|---|---|
| 282 | UCGCGAAAGGCCUUGUGGUACUG | 1434 | 34042 | HCVa:300L21 antisense siNA (282C) inact1 stab08 | GuGccAcAAcGccuuuAGcTsT | 1882 |
| 282 | UCGCGAAAGGCCUUGUGGUACUG | 1434 | 34043 | HCVa:300L21 antisense siNA (282C) inact2 stab08 | uuAccAcAGGGccuuAcGcTsT | 1883 |
| 282 | UCGCGAAAGGCCUUGUGGUACUG | 1434 | 34044 | HCVa:300L21 antisense siNA (282C) inact3 stab08 | GAAccAccAGGcGuuucucTsT | 1884 |
| 283 | CGCGAAAGGCCUUGUGGUACUGC | 1435 | 34045 | HCVa:301L21 antisense siNA (283C) inact1 stab08 | AguGccAcAAuGccuuAcGTsT | 1885 |
| 283 | CGCGAAAGGCCUUGUGGUACUGC | 1435 | 34046 | HCVa:301L21 antisense siNA (283C) inact2 stab08 | AguAGcAcAAuGccucucGTsT | 1886 |
| 283 | CGCGAAAGGCCUUGUGGUACUGC | 1435 | 34047 | HCVa:301L21 antisense siNA (283C) inact3 stab08 | AGcAccucAAGAccuuuGGTsT | 1887 |
| 304 | GCCUGAUAGGGUGCUUGCGAGUG | 1444 | 34048 | HCVa:322L21 antisense siNA (304C) inact1 stab08 | cucAcAAGcAGccuAuccGTsT | 1888 |
| 304 | GCCUGAUAGGGUGCUUGCGAGUG | 1444 | 34049 | HCVa:322L21 antisense siNA (304C) inact2 stab08 | cucccAAGuAcccuAGcAGTsT | 1889 |
| 304 | GCCUGAUAGGGUGCUUGCGAGUG | 1444 | 34050 | HCVa:322L21 antisense siNA (304C) inact3 stab08 | cccGcAAucAccAuAucGGTsT | 1890 |
| 307 | UGAUAGGGUGCUUGCGAGUGCCC | 1446 | 34051 | HCVa:325L21 antisense siNA (307C) inact1 stab08 | GuAcucGccAGcAcccAAuTsT | 1891 |
| 307 | UGAUAGGGUGCUUGCGAGUGCCC | 1446 | 34052 | HCVa:325L21 antisense siNA (307C) inact2 stab08 | ccAcucGcAGGcAccAuAuTsT | 1892 |
| 307 | UGAUAGGGUGCUUGCGAGUGCCC | 1446 | 34053 | HCVa:325L21 antisense siNA (307C) inact3 stab08 | AcAcGcGcAAGuAcccucuTsT | 1893 |
| 282 | UCGCGAAAGGCCUUGUGGUACUG | 1434 | 34054 | HCVa:282U21 sense siNA inv stab07 | B cAuGGuGuuccGGAAAGcGTT B | 1894 |
| 283 | CGCGAAAGGCCUUGUGGUACUGC | 1435 | 34055 | HCVa:283U21 sense siNA inv stab07 | B ucAuGGuGuuccGGAAAGcTT B | 1895 |
| 304 | GCCUGAUAGGGUGCUUGCGAGUG | 1444 | 34056 | HCVa:304U21 sense siNA inv stab07 | B GAGcGuucGuGGGAuAGucTT B | 1896 |
| 307 | UGAUAGGGUGCUUGCGAGUGCCC | 1446 | 34057 | HCVa:307U21 sense siNA inv stab07 | B cGuGAGcGuucGuGGGAuATT B | 1897 |
| 282 | UCGCGAAAGGCCUUGUGGUACUG | 1434 | 34058 | HCVa:300L21 antisense siNA (282C) inv stab08 | cGcuuuccGGAAcAccAuGTsT | 1898 |
| 283 | CGCGAAAGGCCUUGUGGUACUGC | 1435 | 34059 | HCVa:301L21 antisense siNA (283C) inv stab08 | GcuuuccGGAAcAccAuGATsT | 1899 |

TABLE III-continued

HCV Synthetic Modified siNA Constructs

| Target Pos | Target | Seq ID | Cmpd# | Aliases | Sequence | Seq ID |
|---|---|---|---|---|---|---|
| 304 | GCCUGAUAGGGUGCUUGCGAGUG | 1444 | 34060 | HCVa:322L21 antisense siNA (304C) inv stab08 | GAcuAuccAcGAAcGcucTsT | 1900 |
| 307 | UGAUAGGGUGCUUGCGAGUGCCC | 1446 | 34061 | HCVa:325L21 antisense siNA (307C) inv stab08 | uAuccAcGAAcGcuc TABLE III-continued HCV Synthetic Modified siNA Constructs

| Target Pos | Target | Seq ID | Cmpd# | Aliases | Sequence | Seq ID |
|---|---|---|---|---|---|---|
| 315 | GCCCCGGGAGGUCUCGUAGACCG | 1416 | 34142 | HCVb:329L15 (315C) 5'p palindrome siNA | pACGAGACCUCCCGGG AGGUCUCGUB | 1916 |
| 327 | CCCCGGGAGGUCUCGUAGACCGU | 1417 | 34494 | HCVa:345L21 antisense siNA (327C) stab19 | GGucuAcGAGAccuccCGGTT B | 1917 |
| 327 | CCCCGGGAGGUCUCGUAGACCGU | 1417 | 34495 | HCVa:345L21 antisense siNA (327C) inv stab19 | GGcccuccAGAGcAucuGGTT B | 1918 |
| 304 | GCCUGAUAGGGUGCUUGCGAGUG | 1444 | 34496 | HCVa:322L21 antisense siNA (304C) | cucGcAAGcAcccuAucAGTT B stab19 | 1919 |
| 304 | GCCUGAUAGGGUGCUUGCGAGUG | 1444 | 34499 | HCVa:322L21 antisense siNA (304C) inv stab19 | GAcuAuccAcGAcGcucTT B | 1920 |
| 282 | UCGCGAAAGGCCUUGUGUGUACUG | 1434 | 34581 | HCVa:282U21 sense siNA stab00 | GCGAAAGGCCUUGUGUGUACTT | 1921 |
| 283 | CGCGAAAGGCCUUGUGUGUACUGC | 1435 | 34582 | HCVa:283U21 sense siNA stab00 | CGAAAGGCCUUGUGUGUACUTT | 1922 |
| 304 | GCCUGAUAGGGUGCUUGCGAGUG | 1444 | 34583 | HCVa:304U21 sense siNA stab00 | CUGAUAGGGUGCUUGCGAGTT | 1923 |
| 307 | UGAUAGGGUGCUUGCGAGUGCCC | 1446 | 34584 | HCVa:307U21 sense siNA stab00 | AUAGGGUGCUUGCGAGUGCTT | 1924 |
| 327 | CCCCGGGAGGUCUCGUAGACCGU | 1417 | 34585 | HCVa:327U21 sense siNA stab00 | CCGGGAGGUCUCGUAGACCTT | 1925 |
| 282 | UCGCGAAAGGCCUUGUGUGUACUG | 1434 | 34586 | HCVa:300L21 antisense siNA (282C) | GUACCACAAGGCCUUUCGCTT | 1926 |
| 283 | CGCGAAAGGCCUUGUGUGUACUGC | 1435 | 34587 | HCVa:301L21 antisense siNA (283C) stab00 | AGUACCACAAGGCCUUUCGTT | 1927 |
| 304 | GCCUGAUAGGGUGCUUGCGAGUG | 1444 | 34588 | HCVa:322L21 antisense siNA (304C) stab00 | CUCCCAAGCACCCUAUCAGTT | 1928 |
| 307 | UGAUAGGGUGCUUGCGAGUGCCC | 1446 | 34589 | HCVa:325L21 antisense siNA (307C) stab00 | GCACUCGCAAGCACCCUAUTT | 1929 |
| 282 | UCGCGAAAGGCCUUGUGUGUACUG | 1434 | 34590 | HCVa:282U21 sense siNA inv stab00 | CAUGGGUUCCGGAAAGCGTT | 1930 |
| 283 | CGCGAAAGGCCUUGUGUGUACUGC | 1435 | 34591 | HCVa:283U21 sense siNA inv stab00 | UCAUGGGUUCCGGAAAGCTT | 1931 |
| 304 | GCCUGAUAGGGUGCUUGCGAGUG | 1444 | 34592 | HCVa:304U21 sense siNA inv stab00 | GAGCGUUCGUGGGAUAGUCTT | 1932 |
| 307 | UGAUAGGGUGCUUGCGAGUGCCC | 1446 | 34593 | HCVa:307U21 sense siNA inv stab00 | CGUGAGCGUUCGUGGGAUATT | 1933 |
| 327 | CCCCGGGAGGUCUCGUAGACCGU | 1417 | 34594 | HCVa:327U21 sense siNA inv stab00 | CCAGAUGCUCUGGAGGGCCTT | 1934 |
| 282 | UCGCGAAAGGCCUUGUGUGUACUG | 1434 | 34595 | HCVa:300L21 antisense siNA (282C) inv stab00 | CGCUUUCCGGAACACCAUGTT | 1935 |

TABLE III-continued

| HCV Synthetic Modified siNA Constructs | | | | | | |
|---|---|---|---|---|---|---|
| Target Pos | Target | Seq ID | Cmpd# | Aliases | Sequence | Seq ID |
| 283 | CGCGAAAGGCCUUGUGGUACUGC | 1435 | 34596 | HCVa:301L21 antisense siNA (283C) inv stab00 | GCUUUCCGGAACACCAUGATT | 1936 |
| 304 | GCCUGAUAGGGUGCUUGCGAGUG | 1444 | 34597 | HCVa:322L21 antisense siNA (304C) inv stab00 | GACUAUCCCACGAACGCUCTT | 1937 |
| 307 | UGAUAGGGUGCUUGCGAGUGCCC | 1446 | 34598 | HCVa:325L21 antisense siNA (307C) inv stab00 | UAUCCCACGAACGCUCACGTT | 1938 |
| 327 | CCCCGGGAGGUCUCGUAGACCGU | 1417 | 34599 | HCVa:345L21 antisense siNA (327C) inv stab00 | GGCCCUCCAGAGCAUCUGGTT | 1939 |
| 327 | CCCCGGGAGGUCUCGUAGACCGU | 1417 | 35173 | HCVa:327U21 sense siNA stab07 N1 | B ccGGGAGGucucGUAGACCTT B | 1940 |
| 327 | CCCCGGGAGGUCUCGUAGACCGU | 1417 | 35174 | HCVa:345L21 antisense siNA (327C) stab08 N1 | GGUCUAcGAGAccucccGGTsT | 1941 |
| 327 | CCCCGGGAGGUCUCGUAGACCGU | 1417 | 35175 | HCVa:345L21 antisense siNA (327C) stab25 | GGUcuAcGAGAccucccGGTsT | 1942 |
| 327 | CCCCGGGAGGUCUCGUAGACCGU | 1417 | 35176 | HCVa:345L21 antisense siNA (327C) stab08 N3 | GGucuAcGAGAccucccGGTsT | 1943 |
| 327 | CCCCGGGAGGUCUCGUAGACCGU | 1417 | 35177 | HCVa:345L21 antisense siNA (327C) stab24 | GGucuAcGAGAccucccGGTsT | 1944 |
| 304 | GCCUGAUAGGGUGCUUGCGAGUG | 1444 | 35178 | HCVa:304U21 sense siNA stab07 N1 | B cuGAuAGGGuGcuUGCGAGTT B | 1945 |
| 304 | GCCUGAUAGGGUGCUUGCGAGUG | 1444 | 35179 | HCVa:322L21 antisense siNA (304C) stab08 N1 | CUCGCAAGcAcccuAucAGTsT | 1946 |
| 304 | GCCUGAUAGGGUGCUUGCGAGUG | 1444 | 35180 | HCVa:322L21 antisense siNA (304C) stab25 | CUCGcAAGcAcccuAucAGTsT | 1947 |
| 304 | GCCUGAUAGGGUGCUUGCGAGUG | 1444 | 35181 | HCVa:322L21 antisense siNA (304C) stab08 N3 | CUcGcAAGcAcccuAucAGTsT | 1948 |
| 304 | GCCUGAUAGGGUGCUUGCGAGUG | 1444 | 35182 | HCVa:322L21 antisense siNA (304C) stab24 | CucGcAAGcAcccuAucAGTsT | 1949 |
| 327 | CCCCGGGAGGUCUCGUAGACCGU | 1417 | 35225 | HCVa:327 siNA stab0/0 Pal01 | GGUCUACGAGACCUCCCGG CCGGGAGGUCUCGUAGACC | 1950 |
| 327 | CCCCGGGAGGUCUCGUAGACCGU | 1417 | 35226 | HCVa:327 siNA stab0/0 Pal02 | GGUCUACGAGACCUCCCGG CCGGGAGGUCUCGUAGACCTT | 1951 |
| 327 | CCCCGGGAGGUCUCGUAGACCGU | 1417 | 35227 | HCVa:327 siNA stab0/0 Pal03 | GGUCUACGAGACCUCCCG CGGGAGGUCUCGUAGACC | 1952 |

TABLE III-continued

HCV Synthetic Modified siNA Constructs

| Target Pos | Target | Seq ID | Cmpd# | Aliases | Sequence | Seq ID |
|---|---|---|---|---|---|---|
| 327 | CCCCGGAGGUCUCGUAGACCGU | 1417 | 35228 | HCVa:327 siNA stab0/0 Pal04 | GGUCUACGAGACCUCCCG CGGGAGGUCUCGUAGACCTT | 1953 |
| 327 | CCCCGGAGGUCUCGUAGACCGU | 1417 | 35229 | HCVa:327 siNA stab0/0 Pal05 | GGUCUACGAGACCUCCC GGGAGGUCUCGUAGACC | 1954 |
| 327 | CCCCGGAGGUCUCGUAGACCGU | 1417 | 35230 | HCVa:327 siNA stab0/0 Pal06 | GGUCUACGAGACCUCCC GGGAGGUCUCGUAGACCTT | 1955 |
| 327 | CCCCGGAGGUCUCGUAGACCGU | 1417 | 35231 | HCVa:327 siNA stab0/0 Pal07 | GGUCUACGAGACCUCC GGAGGUCUCGUAGACC | 1956 |
| 327 | CCCCGGAGGUCUCGUAGACCGU | 1417 | 35232 | HCVa:327 siNA stab0/0 Pal08 | GGUCUACGAGACCUCC GGAGGUCUCGUAGACCTT | 1957 |
| 327 | CCCCGGAGGUCUCGUAGACCGU | 1417 | 35235 | HCVa:327 siNA stab0/0 Pal11 | GUCUACGAGACCUCCCGG GAGGUCUCGUAGAC | 1958 |
| 327 | CCCCGGAGGUCUCGUAGACCGU | 1417 | 35236 | HCVa:327 siNA stab0/0 Pal12 | GUCUACGAGACCUCCGG GAGGUCUCGUAGACTT | 1959 |
| 327 | CCCCGGAGGUCUCGUAGACCGU | 1417 | 35237 | HCVa:327 siNA stab0/0 Pal13 | UCUACGAGACCUCCCGG GAGGUCUCGUAGA | 1960 |
| 327 | CCCCGGAGGUCUCGUAGACCGU | 1417 | 35238 | HCVa:327 siNA stab0/0 Pal14 | UCUACGAGACCUCCGG GAGGUCUCGUAGATT | 1961 |
| 327 | CCCCGGAGGUCUCGUAGACCGU | 1417 | 35239 | HCVa:327 siNA stab0/0 Pal15 | CUACGAGACCUCCCGG GAGGUCUCGUAG | 1962 |
| 327 | CCCCGGAGGUCUCGUAGACCGU | 1417 | 35240 | HCVa:327 siNA stab0/0 Pal16 | CUACGAGACCUCCCGG GAGGUCUCGUAGTT | 1963 |
| 327 | CCCCGGAGGUCUCGUAGACCGU | 1417 | 35241 | HCVa:327 siNA stab0/0 Pal17 | GGUCUACGAGACCUCCAGG UCUCGUAGACC | 1964 |
| 327 | CCCCGGAGGUCUCGUAGACCGU | 1417 | 35242 | HCVa:327 siNA stab0/0 Pal18 | GGUCUACGAGACCUCCAGG UCUCGUAGACCTT | 1965 |
| 327 | CCCCGGAGGUCUCGUAGACCGU | 1417 | 35243 | HCVa:327 siNA stab0/0 Pal19 | GGUCUACGAGACCUCGAGG UCUCGUAGACC | 1966 |
| 327 | CCCCGGAGGUCUCGUAGACCGU | 1417 | 35244 | HCVa:327 siNA stab0/0 Pal20 | GGUCUACGAGACCUCGAGG UCUCGUAGACCTT | 1967 |
| 327 | CCCCGGAGGUCUCGUAGACCGU | 1417 | 35245 | HCVa:327 siNA stab0/0 Pal21 | GGUCUACGAGACCUGCAGG UCUCGUAGACC | 1968 |
| 327 | CCCCGGAGGUCUCGUAGACCGU | 1417 | 35246 | HCVa:327 siNA stab0/0 Pal22 | GGUCUACGAGACCUGCAGG UCUCGUAGACCTT | 1969 |
| 304 | GCCUGAUAGGGUGCUUGCGAGUG | 1444 | 35247 | HCVa:304 siNA stab0/0 Pal01 | GACUAUCCCACGAACGCUC GAGCGUUCGUGGGAUAGUCTT | 1970 |

TABLE III-continued

HCV Synthetic Modified siNA Constructs

| Target Pos | Target | Seq ID | Cmpd# | Aliases | Sequence | Seq ID |
|---|---|---|---|---|---|---|
| 304 | GCCUGAUAGGGUGCUUGCGAGUG | 1444 | 35248 | HCVa:304 siNA stab0/0 Pal02 | GACUAUCCCACGAACGCUC GAGCGUUCGUGGGAUAGUC | 1971 |
| 304 | GCCUGAUAGGGUGCUUGCGAGUG | 1444 | 35249 | HCVa:304 siNA stab0/0 Pal03 | GACUAUCCCACGAACGCGU UCGUGGGAUAGUCTT | 1972 |
| 304 | GCCUGAUAGGGUGCUUGCGAGUG | 1444 | 35250 | HCVa:304 siNA stab0/0 Pal04 | GACUAUCCCACGAACGCGU UCGUGGGAUAGUC | 1973 |
| 304 | GCCUGAUAGGGUGCUUGCGAGUG | 1444 | 35251 | HCVa:304 siNA stab0/0 Pal05 | GACUAUCCCACGAACGUUC GUGGGAUAGUCTT | 1974 |
| 304 | GCCUGAUAGGGUGCUUGCGAGUG | 1444 | 35252 | HCVa:304 siNA stab0/0 Pal06 | GACUAUCCCACGAACGUUC GUGGGAUAGUC | 1975 |
| 304 | GCCUGAUAGGGUGCUUGCGAGUG | 1444 | 35253 | HCVa:304 siNA stab0/0 Pal07 | ACUAUCCCACGAACGUUC GUGGGAUAGUTT | 1976 |
| 304 | GCCUGAUAGGGUGCUUGCGAGUG | 1444 | 35254 | HCVa:304 siNA stab0/0 Pal08 | ACUAUCCCACGAACGUUC GUGGGA | 1977 |
| 327 | CCCCGGAGGUCUCGUAGACCGU UCGCGAAAGGCCUUGUGGUACUG | 1462 | 36414 | HCVa bf-L-21 siNA stab00 [HCVa:327U21 sense o18S HCVa:282U21 sense] | CCGGGAGGUCUCGUAGACCTT L GCGAAAGGCCUUGUGGUACTT | 1978 |
| 327 | CCCCGGAGGUCUCGUAGACCGU UGAUAGGGUGCUUGCGAGUGCCC | 1463 | 36415 | HCVa bf-L-22 siNA stab00 [HCVa:327U21 sense o18S HCVa:307U21 sense] | CCGGGAGGUCUCGUAGACCTT L AUAGGGUGCUUGCGAGUGCTT | 1979 |
| 307 | UGAUAGGGUGCUUGCGAGUGCCC UCGCGAAAGGCCUUGUGGUACUG | 1464 | 36430 | HCVa bf-L-20 siNA stab00 [HCVa:307U21 sense o18S HCVa:282U21 sense] | AUAGGGUGCUUGCGAGUGCTT L GCGAAAGGCCUUGUGGUACTT | 1980 |
| 307 | UGAUAGGGUGCUUGCGAGUGCCC | 1446 | 36438 | HCVa:307U21 sense siNA stab00 | AUAGGGUGCUUGCGAGUGCTT | 1924 |
| 307 | UGAUAGGGUGCUUGCGAGUGCCC | 1446 | 36446 | HCVa:325L21 antisense siNA (307C) stab00 | GCACUCGCAAGCACCCUAUTT | 1929 |
| 327 | CCCCGGAGGUCUCGUAGACCGU | 1417 | 36447 | HCVa:345L21 antisense siNA (327C) stab00 | GGUCUAGAGACCUCCCGGTT | 1732 |
| 304 | GCCUGAUAGGGUGCUUGCGAGUG | 1444 | 36727 | HCVa:304U21 sense siNA stab09 | B CUGAUAGGGUGCUUGCCAGTT B | 1981 |
| 304 | GCCUGAUAGGGUGCUUGCGAGUG | 1444 | 36728 | HCVa:322L21 antisense siNA (304C) stab10 | CUCGCAAGCACCCUAUCAGTsT | 1982 |
| 304 | GCCUGAUAGGGUGCUUGCGAGUG | 1444 | 37010 | HCVa:304U21 sense siNA stab04 | B cuGAuAGGGuGcuuGcCAGTT B | 1983 |
| 304 | GCCUGAUAGGGUGCUUGCGAGUG | 1444 | 37011 | HCVa:322L21 antisense siNA (304C) stab05 | cucGcAAGcAcccuAucAGTsT | 1984 |

TABLE III-continued

HCV Synthetic Modified siNA Constructs

| Target Pos | Target | Seq ID | Cmpd# | Aliases | Sequence | Seq ID |
|---|---|---|---|---|---|---|
| 307 | CCCCGGAGGUCUCGUAGACCGU UGAUAGGGUGCUUGCGAGUGCCC | 1463 | 37781 | HCVa bf-L-22 siNA stab07 [HCVa:327U21 sense o18S HCVa:307U21 sense] | B ccGGGAGGucucGuAGAccTT L AuAGGGuGcuuGcGAGuGcTT B | 1985 |
| 307 | UGAUAGGGUGCUUGCGAGUGCCC | 1446 | 37790 | HCVa:325L21 antisense siNA (307C) stab26 | GCAcucGcAAGcAcccuAuTT | 1986 |
| 327 | CCCCGGAGGUCUCGUAGACCGU | 1417 | 37791 | HCVa:345L21 antisense siNA (327C) stab26 | GGUcuAcGAGAccuccGGTT | 1987 |
| 282 | UCGCGAAAGGCCUUGUGGUACUG | 1434 | 38279 | HCVa:300L21 antisense siNA (282C) stab25 | GUAccAcAAGGccuuucGcTsT | 1988 |
| 283 | CGCGAAAGGCCUUGUGGUACUGC | 1435 | 38280 | HCVa:301L21 antisense siNA (283C) stab25 | AGUAccAcAAGGccuuucGTsT | 1989 |
| 307 | UGAUAGGGUGCUUGCGAGUGCCC | 1446 | 38281 | HCVa:325L21 antisense siNA (307C) stab25 | GCAcucGcAAGcAcccuAuTsT | 1990 |
| 304 | GCCUGAUAGGGUGCUUGCGAGUG | 1444 | 38283 | HCVa:322L21 antisense siNA (304C) stab26 | CUCGcAAGcAcccuAucAGTT | 1991 |
| 304 | GCCUGAUAGGGUGCUUGCGAGUG | 1444 | 38284 | HCVa:322L21 antisense siNA (304C) stab27 | CUCGcAAGcAcccuAucAGTTB | 1992 |
| 282 | UCGCGAAAGGCCUUGUGGUACUG | 1434 | 38293 | HCVa:300L21 antisense siNA (282C) stab19 | GuAccAcAAGGccuuucGcTT B | 1993 |
| 282 | UCGCGAAAGGCCUUGUGGUACUG | 1434 | 38294 | HCVa:300L21 antisense siNA (282C) stab26 | GUAccAcAAGGccuuucGcTT | 1994 |
| 282 | UCGCGAAAGGCCUUGUGGUACUG | 1434 | 38295 | HCVa:300L21 antisense siNA (282C) stab27 | GUAccAcAAGGccuuucGcTT B | 1995 |
| 282 | UCGCGAAAGGCCUUGUGGUACUG | 1434 | 38296 | HCVa:300L21 antisense siNA (282C) stab29 | GuAccAcAAGGccuuucGcTsT | 1996 |
| 282 | UCGCGAAAGGCCUUGUGGUACUG | 1434 | 38297 | HCVa:300L21 antisense siNA (282C) stab30 | GuAccAcAAGGccuuucGcTT | 1997 |
| 282 | UCGCGAAAGGCCUUGUGGUACUG | 1434 | 38298 | HCVa:300L21 antisense siNA (282C) stab31 | GuAccAcAAGGccuuucGcTT B | 1998 |
| 282 | UCGCGAAAGGCCUUGUGGUACUG | 1434 | 38299 | HCVa:300L21 antisense siNA (282C) stab32 | GuAccAcAAGGccuuucGcTT | 1999 |
| 304 | GCCUGAUAGGGUGCUUGCGAGUG | 1444 | 38300 | HCVa:322L21 antisense siNA (304C) stab32 | cucGcAAGcAcccuAucAGTT | 2000 |

TABLE III-continued

HCV Synthetic Modified siNA Constructs

| Target Pos | Target | Seq ID | Cmpd# | Aliases | Sequence | Seq ID |
|---|---|---|---|---|---|---|
| 327 | CCCCGGGAGGUCUCGUAGACCGU | 1417 | 38301 | HCVa:345L21 antisense siNA (327C) stab27 | GGUcuAcGAGAccuucccGGTT B | 2001 |
| 327 | CCCCGGGAGGUCUCGUAGACCGU | 1417 | 38302 | HCVa:345L21 antisense siNA (327C) stab30 | GGucuAcGAGAccuucccGTT | 2002 |
| 327 | CCCCGGGAGGUCUCGUAGACCGU | 1417 | 38303 | HCVa:345L21 antisense siNA (327C) stab31 | GGucuAcGAGAccuucccGGTT B | 2003 |
| 327 | CCCCGGGAGGUCUCGUAGACCGU | 1417 | 38304 | HCVa:345L21 antisense siNA (327C) stab32 | GGucuAcGAGAccuucccGGTT | 2004 |
| 304 | CCCCGGGAGGUCUCGUAGACCGU GCCUGAUAGGGUGCUUGCGAGUG | 1465 | 38310 | HCV bf-L-23 siNA stab00 [HCV:327U21 sense o18S HCV:304U21 sense] | CCGGGAGGUCUCGUAGACCTT L CUGAUAGGGUGCUUGCGAGTT | 2005 |
| 282 | GCCUGAUAGGGUGCUUGCGAGUG UCGCGAAAGGCCUUGUGGUACUG | 1466 | 38311 | HCV bf-L-24 siNA stab00 [HCV:304U21 sense o18S HCV:282U21 sense] | CUGAUAGGGUGCUUGCGAGTT L GCGAAAGGCCUUGUGGUACTT | 2006 |
| 304 | CCCCGGGAGGUCUCGUAGACCGU GCCUGAUAGGGUGCUUGCGAGUG | 1465 | 38312 | HCV bf-L-23 siNA stab07 [HCV:327U21 sense o18S HCV:304U21 sense] | B ccGGGAGGucucGuAGAccTT L cuGAuAGGGuGcuuGcGAGTT B | 2007 |
| 282 | CCCCGGGAGGUCUCGUAGACCGU UCGCGAAAGGCCUUGUGGUACUG | 1462 | 38313 | HCV bf-L-21 siNA stab07 [HCV:327U21 sense o18S HCVa:282U21 sense] | B ccGGGAGGucucGuAGAccTT L GcGAAAGGcccuuGuGGuACTT B | 2008 |
| 282 | GCCUGAUAGGGUGCUUGCGAGUG UCGCGAAAGGCCUUGUGGUACUG | 1466 | 38314 | HCV bf-L-24 siNA stab07 [HCV:304U21 sense o18S HCV:282U21 sense] | B cuGAuAGGGuGcuuGcGAGTT L GcGAAAGGcccuuGuGGuACTT B | 2009 |
| 304 | GCCUGAUAGGGUGCUUGCGAGUG | 1444 | 38758 | HCVa:322L21 siRNA (304C) stab26 | CUCGcAAGcAcccuAucAGUU | 2010 |
| 327 | CCCCGGGAGGUCUCGUAGACCGU | 1417 | 38759 | HCVa:345L21 siRNA (327C) stab26 | GGUcuAcGAGAccuucccGGUU | 2011 |
| 304 | GCCUGAUAGGGUGCUUGCGAGUG | 1444 | 46211 | HCVa:322L21 siRNA (304C) stab26 | CUCGcAAGcAcccuAucAGGC | 2012 |
| 327 | CCCCGGGAGGUCUCGUAGACCGU | 1417 | 46214 | HCVa:345L21 siRNA (327C) stab26 | GGUcuAcGAGAccuucccGGGC | 2013 |
| 292 | CUGAUAGGGCGCUUGCCAG | 2014 | 46672 | HCV-JFH-1::(292)U23 siRNA stab07 active | B cuGAuAGGGcGcuuGcGcGAGTT B | 2034 |
| 292 | CUGAUAGGGCGCUUGCCAG | 2014 | 46673 | HCV-JFH-1::(292)L21 siRNA stab25 active | CUCGcAAGcGcccuAucAGTsT | 2035 |
| | | | 46746 | HCVa:(293)U23 siRNA stab07 control01 | B cuGAuAcccAcGAuGcGAGTT B | 2036 |

TABLE III-continued

| HCV Synthetic Modified siNA Constructs | | | | | | |
|---|---|---|---|---|---|---|
| Target Pos | Target | Seq ID | Cmpd# | Aliases | Sequence | Seq ID |
| | | | 46747 | HCVa:(316)U23 siRNA stab07 control01 | B ccGGGAccAGAGcuAGAccTT B | 2037 |
| | | | 46748 | HCVa:(271)U23 siRNA stab07 control01 | B GcGAAAccGGAAcuGGuAcTT B | 2038 |
| | | | 46751 | HCVa:(293)L21 siRNA stab25 control01 | CUCGcAucGuGGGuAucAGTsT | 2039 |
| | | | 46752 | HCVa:(316)L21 siRNA stab25 control01 | GGUcuAGcucuGGucccGGTsT | 2040 |
| | | | 46753 | HCVa:(271)L21 siRNA stab25 control01 | GUAccAGuuccGGuuucGcTsT | 2041 |
| | | | 46755 | HCVa:(316)L21 siRNA stab29 control01 | GGucuAGcucuGGucccGGTsT | 2042 |
| | | | 46756 | HCVa:(271)U21 siRNA stab29 control01 | GuAccAGuuccGGuuucGcTsT | 2043 |
| | | | 46757 | HCVa:(293)L21 siRNA stab08 control01 | cucGcAucGuGGGuAucAGTsT | 2044 |
| 293 | GCCUGAUAGGGUGCUUGCGAGUG | 1444 | 47023 | HCVa:(293)L21 siRNA stab25 invert | GACuAucccAcGAAcGcucTsT | 2045 |
| 293 | GCCUGAUAGGGUGCUUGCGAGUG | 1444 | 47024 | HCVa:(293)L21 siRNA stab25A invert | GAcuAucccAcGAAcGCUCTsT | 2046 |
| 293 | GCCUGAUAGGGUGCUUGCGAGUG | 1444 | 47025 | HCVa:(293)U22 siRNA stab07 3' n-1 | B cuGAuAGGGuGcuuGcGAGTT | 2047 |
| 293 | GCCUGAUAGGGUGCUUGCGAGUG | 1444 | 47026 | HCVa:(293)U21 siRNA stab07 3' n-2 | B cuGAuAGGGuGcuuGcGAGT | 2048 |
| 293 | GCCUGAUAGGGUGCUUGCGAGUG | 1444 | 47027 | HCVa:(293)U22 siRNA stab07 5' n-1 | cuGAuAGGGuGcuuGcGAGTT B | 2049 |
| 293 | GCCUGAUAGGGUGCUUGCGAGUG | 1444 | 47028 | HCVa:(293)U21 siRNA stab07 5'-2 | uGAuAGGGuGcuuGcGAGTT B | 2050 |
| 293 | GCCUGAUAGGGUGCUUGCGAGUG | 1444 | 47029 | HCVa:(293)U20 siRNA stab07 5'-3 | GAuAGGGuGcuuGcGAGTT B | 2051 |
| 293 | GCCUGAUAGGGUGCUUGCGAGUG | 1444 | 47030 | HCVa:(293)L20 siRNA stab08 3'-1 | cucGcAAGcAcccuAucAGT | 2052 |
| 293 | GCCUGAUAGGGUGCUUGCGAGUG | 1444 | 47031 | HCVa:(293)L19 siRNA stab08 3'-2 | cucGcAAGcAcccuAucAG | 2053 |
| 293 | GCCUGAUAGGGUGCUUGCGAGUG | 1444 | 47032 | HCVa:(293)L18 siRNA stab08 3'-3 | cucGcAAGcAcccuAucA | 2054 |
| 293 | GCCUGAUAGGGUGCUUGCGAGUG | 1444 | 47033 | HCVa:(293)L20 siRNA stab08 5'-1 | ucGcAAGcAcccuAucAGTsT | 2055 |
| 293 | GCCUGAUAGGGUGCUUGCGAGUG | 1444 | 47034 | HCVa:(293)L19 siRNA stab08 5'-2 | cGcAAGcAcccuAucAGTsT | 2056 |
| 293 | GCCUGAUAGGGUGCUUGCGAGUG | 1444 | 47035 | HCVa:(293)L18 siRNA stab08 5'-3 | GcAAGcAcccuAucAGTsT | 2057 |

TABLE III-continued

| HCV Synthetic Modified siNA Constructs | | | | | | |
|---|---|---|---|---|---|---|
| Target Pos | Target | Seq ID | Cmpd# | Aliases | Sequence | Seq ID |
| 293 | GCCUGAUAGGGUGCUUGCGAGUG | 1444 | 47036 | HCVa:(293)L20 SiRNA stab25 3'-1 | CUCGcAAGcAcccuAucAGT | 2058 |
| 293 | UGAUAGGGUGCUUGCGAG | 2015 | 47038 | HCVa:(293)L18 siRNA stab25 3' n-3 | CUCGcAAGcAcccuAucA | 2059 |
| 293 | GCCUGAUAGGGUGCUUGCGAGUG | 1444 | 47039 | HCVa:(293)L20 siRNA stab25 5'-1 | UCGcAAGcAcccuAucAGTsT | 2060 |
| 293 | AACUGAUAGGGUGCUUGCG | 2016 | 47040 | HCVa:(293)L19 siRNA stab25 5'-2 | CGcAAGcAcccuAucAGTsT | 2061 |
| 73 | GUCUUCACGCAGAAAGCGUCUAG | 2017 | 47208 | HCVa:(73)U23 siRNA stab07 | B cuucAcGcAGAAAGcGucuTT B | 2062 |
| 86 | AAGCGUCUAGCCAUGGCGUUAGU | 2018 | 47209 | HCVa:(86)U23 siRNA stab07 | B GcGucuAGccAuGGcGuuATT B | 2063 |
| 172 | GUGAGUACACCGGAAUUGCCAGG | 2019 | 47212 | HCVa:(172)U23 siRNA stab07 | B GAGuAcAccGGAAuuGccATT B | 2064 |
| 195 | ACGACCGGGUCCUUUCUUGGAUC | 2020 | 47213 | HCVa:(195)U23 siRNA stab07 | B GAccGGGuccuuucuuGGATT B | 2065 |
| 220 | CCCGCUCAAUGCCUGGAGAUUUG | 2021 | 47214 | HCVa:(220)U23 siRNA stab07 | B cGcucAAuGccuGGAGAuuTT B | 2066 |
| 250 | CCCCGCGAGACUGCUAGCCGAGU | 2022 | 47215 | HCVa:(250)U23 siRNA stab07 | B ccGcGAGAcuGcuAGccGATT B | 2067 |
| 252 | CCGCGAGACUGCUAGCCGAGUAG | 2023 | 47216 | HCVa:(252)U23 siRNA stab07 | B GcGAGAcuGcuAGccGAGuTT B | 2068 |
| 267 | CCGAGUAGUGUUGGGUCGCGAAA | 2024 | 47217 | HCVa:(267)U23 siRNA stab07 | B GAGuAGuGuuGGGucGcGATT B | 2069 |
| 274 | GUGUUGGGUCGCGAAAGGCCUUG | 2025 | 47218 | HCVa:(274)U23 siRNA stab07 | B GuuGGGucGcGAAAGGccuTT B | 2070 |
| 277 | UUGGGUCGCGAAAGGCCUUGUGG | 2026 | 47219 | HCVa:(277)U23 siRNA stab07 | B GGGucGcGAAAGGccuuGuTT B | 2071 |
| 73 | GUCUUCACGCAGAAAGCGUCUAG | 2017 | 47222 | HCVa:(73)L21 siRNA stab25 | AGAcGcuuucuGcGuGAAGTsT | 2072 |
| 86 | AAGCGUCUAGCCAUGGCGUUAGU | 2018 | 47223 | HCVa:(86)L21 siRNA stab25 | UAAcGccAuGGcuAGAcGcTsT | 2073 |
| 140 | UCCCGGGAGAGCCAUAGUGGUCU | 1420 | 47224 | HCVa:(140)L21 siRNA stab25 | ACCAcuAuGGcucucccGGTsT | 2074 |
| 157 | UGGUCUGCGGAACCGGUGAGUAC | 1426 | 47225 | HCVa:(157)L21 siRNA stab25 | ACUcAccGGuuccGcAGAcTsT | 2075 |
| 172 | GUGAGUACACCGGAAUUGCCAGG | 2019 | 47226 | HCVa:(172)L21 siRNA stab25 | UGGcAAuuccGGuGuAcucTsT | 2076 |
| 195 | ACGACCGGGUCCUUUCUUGGAUC | 2020 | 47227 | HCVa:(195)L21 siRNA stab25 | UCCAAGAAAGGAcccGGucTsT | 2077 |
| 220 | CCCGCUCAAUGCCUGGAGAUUUG | 2021 | 47228 | HCVa:(220)L21 siRNA stab25 | AAUcuccAGGcAuuGAGcGTsT | 2078 |
| 250 | CCCCGCGAGACUGCUAGCCGAGU | 2022 | 47229 | HCVa:(250)L21 siRNA stab25 | UCGGcuAGcAGucucGcGGTsT | 2079 |
| 252 | CCGCGAGACUGCUAGCCGAGUAG | 2023 | 47230 | HCVa:(252)L21 siRNA stab25 | ACUcGGcuAGcAGucucGcTsT | 2080 |
| 267 | CCGAGUAGUGUUGGGUCGCGAAA | 2024 | 47231 | HCVa:(267)L21 siRNA stab25 | UCGcGAcccAAcAcuAcucTsT | 2081 |

TABLE III-continued

HCV Synthetic Modified siNA Constructs

| Target Pos | Target | Seq ID | Cmpd# | Aliases | Sequence | Seq ID |
|---|---|---|---|---|---|---|
| 274 | GUGUUGGGUCGCGAAAGGCCUUG | 2025 | 47232 | HCVa:(274)L21 siRNA stab25 | AGGccuuucGcGAcccAAcTsT | 2082 |
| 277 | UUGGGUCGCGAAAGGCCUUGUGG | 2026 | 47233 | HCVa:(277)L21 siRNA stab25 | ACAAGGccuuucGcGAcccTsT | 2083 |
| 303 | UGCCUGAUAGGGUGCUUGCGAGU | 1410 | 47234 | HCVa:(303)L21 siRNA stab25 | UCGcAAGcAcccuAucAGTsT | 2084 |
| 329 | CCGGGAGGUCUCGUAGACCGUGC | 1419 | 47235 | HCVa:(329)L21 siRNA stab25 | ACGUcuAcGAGAccucccTsT | 2085 |
| | | | 47354 | HCVa:(293)U23 siRNA stab04 invert B | GAGCGuucGuGGGAuAGucTT | 2086 |
| | | | 47527 | HCVa:(316)L21 siRNA stab29A invert | GGcccuccAGAGcAucuGTsT | 2087 |
| | GAAAGGAUUUGGCUACAAA | 2027 | 47654 | HCVa/PPIB:(300)U25 bifunctional stab00 active | UUUGUAGCCAAAUCCUUUCUGGUAC | 2088 |
| | AAGGAUUUGGCUACAAAAA | 2028 | 47655 | HCVa/PPIB:( )U27 bifunctional stab00 active | UUUUUGUAGCCAAAUCCUUUGUGUAC | 2089 |
| | AAGGACUUCAUGAUCCAGG | 2029 | 47663 | HCVa/PPIB:( )U27 bifunctional stab00 active | CCUGGAUCAUGAAGUCCUUUGUGUAC | 2090 |
| | GAGAGCACCAAGACAGACA | 2030 | 47664 | HCVa/PPIB:( )U27 bifunctional stab00 active | UGUCUGUCUUGGUGCUCUCCUUGCGAG | 2091 |
| | AAAGACUGUCCAAAAACA | 2031 | 47665 | HCVa/PPIB:( )U24 bifunctional stab00 active | UGUUUUGGAACAGUCUUUGCGAG | 2092 |
| | GAGAGCACCAAGACAGACA | 2030 | 47666 | HCVa/PPIB:( )U26 bifunctional stab00 active | UGUCUGUCUUGGUGCUCUCGUAGACC | 2093 |
| | AGAUGGCACAGAGGAAAG | 2032 | 47667 | HCVa/PPIB:( )U27 bifunctional stab00 active | CUUUCCUCUGUGCCAUCUCGUAGACC | 2094 |
| | GCGAAAGGCCUUGUGUAC | 8 | 47668 | HCVa/PPIB:( )L25 bifunctional stab00 active | GUACCACAAGGCCUUUCGCUACAAA | 2095 |
| | GCGAAAGGCCUUGUGUAC | 8 | 47669 | HCVa/PPIB:( )L27 bifunctional stab00 active | GUACCACAAGGCCUUUCGCUACAAAAA | 2096 |
| | GCGAAAGGCCUUGUGUAC | 8 | 47670 | HCVa/PPIB:( )L27 bifunctional stab00 active | GUACCACAAGGCCUUUCGCGAUCCAGG | 2097 |
| | CUGAUAGGGUGCUUGCGAG | 2033 | 47671 | HCVa/PPIB:( )L27 bifunctional stab00 active | CUCGCAAGCACCCUAUCAGGACAGACA | 2098 |
| | CUGAUAGGGUGCUUGCGAG | 2033 | 47672 | HCVa/PPIB:( )L24 bifunctional stab00 active | CUCGCAAGCACCCUAUCGAAACA | 2099 |

TABLE III-continued

HCV Synthetic Modified siNA Constructs

| Target Pos | Target | Seq ID | Cmpd# | Aliases | Sequence | Seq ID |
|---|---|---|---|---|---|---|
| 293 | CCGGGAGGUCUCGUAGACC | 38 | 47673 | HCVa/PPIB:( )L26 bifunctional stab00 active | GGUCUACGAGACCUCCCGGACAGACA | 2100 |
| 293 | CCGGGAGGUCUCGUAGACC | 38 | 47674 | HCVa/PPIB:( )L27 bifunctional stab00 active | GGUCUACGAGACCUCCCGGAGGAAAG | 2101 |
| 316 | GCCUGAUAGGGUGCUUGCGAGUG | 1444 | 47677 | HCVa:(293)L21 siRNA stab36 active | CUCGCAAGCAcccuAucAGGC | 2102 |
| 282 | CCCCGGGAGGUCUCGUAGACCGU | 1417 | 38756 | HCVa:334L21 siRNA (316C) stab36 | GGUCUACGAGAccuccCGGGG | 2103 |
| 304 | UCGCGAAAGGCCUUGUGGUACUG | 1434 | 47786 | HCV:(282)U23 siRNA stab07B active | B GcGAAAGCCuuGuGGuAcTT B | 2104 |
| 327 | GCCUGAUAGGGUGCUUGCGAGUG | 1444 | 47787 | HCV:(304)U23 siRNA stab07B active | B cuGAuAGGGUGcuuGcGAGTT B | 2105 |
| 316 | CCCCGGGAGGUCUCGUAGACCGU | 1417 | 47788 | HCV:(327)U23 siRNA stab07B active | B ccGGGAGGUCUcGuAGAccTT B | 2106 |
| 282 | UCGCGAAAGGCCUUGUGGUACUG | 1434 | 47791 | HCVa:(316)L21 siRNA stab35 active | GGUcAGcucuGGucccGGUU | 2107 |
| 293 | GCCUGAUAGGGUGCUUGCGAGUG | 1444 | 47855 | HCVa:(282)U21 siRNA stab07C | B GcGAAAGCCuuGuGGuAc B | 2108 |
| 316 | CCCCGGGAGGUCUCGUAGACCGU | 1417 | 47856 | HCVa:(293)U21 siRNA stab07C | B cuGAuAGGGUGcuuGcGAG B | 2109 |
| 282 | UCGCGAAAGGCCUUGUGGUACUG | 1434 | 47857 | HCVa:(316)U21 siRNA stab07C | B ccGGGAGGUCUcGuAGAcc B | 2110 |
| 304 | GCCUGAUAGGGUGCUUGCGAGUG | 1444 | 47860 | HCVa:(282)U20 siRNA stab07D | B GcGAAAGCCuuGuGGuAc B | 2111 |
| 316 | CCCCGGGAGGUCUCGUAGACCGU | 1417 | 47861 | HCV:(304)U20 siRNA stab07D active | B cuGAuAGGGUGcuuGcGAG B | 2112 |
| 73 | GUCUUCACGCAGAAAGCGCUCUAG | 2017 | 47862 | HCVa:(316)U20 siRNA stab07 3'-3 | B ccGGGAGGUCUcGuAGAcc B | 2113 |
| 86 | AAGCGUCUAGCCAUGGCGUUAGU | 2018 | 47878 | HCV:(73)U23 siRNA stab07B active | B cuucAcGcAGAAAGcGcucuTT B | 2114 |
| 140 | UCCCGGGAGAGCCAUAUGGUCU | 1420 | 47879 | HCVa:(86)U23 siRNA stab07B active | B GCGcucuAGCCAuGGcGuuATT B | 2115 |
| 157 | UGGUCUGCGGAACCGGUGAGUAC | 1426 | 47880 | HCVa:(140)U23 siRNA stab07B active | B ccGGGAGAGCCAuAuGGuTT B | 2116 |
| 303 | UGCCUGAUAGGGUGCUUGCGAGU | 1410 | 47881 | HCVa:(157)U23 siRNA stab07B active | B GUcuGCGGAAccGGuGAGuTT B | 2117 |
| 329 | CCGGGAGGUCUCGUAGACCGUGC | 1419 | 47882 | HCVa:(303)U23 siRNA stab07B | B ccuGAuAGGGuGcuuGcGATT B | 2118 |
| | | | 47883 | HCVa:(329)U23 siRNA stab07B active | B GGGAGGUcUCGuAGAccGuTT B | 2119 |

TABLE III-continued

| HCV Synthetic Modified siNA Constructs | | | | | | |
|---|---|---|---|---|---|---|
| Target Pos | Target | Seq ID | Cmpd# | Aliases | Sequence | Seq ID |
| 73 | GUCUUCACGCAGAAAGCGUCUAG | 2017 | 47884 | HCVa:(73)U23 siRNA stab09 active | B CUUCACGCAGAAAGCGUCUTT B | 2120 |
| 86 | AAGCGUCUAGCCAUGGCGUUAGU | 2018 | 47885 | HCVa:(86)U23 siRNA stab09 active | B GCGUCUAGCCAUGGCGUUATT B | 2121 |
| 140 | UCCCGGGAGAGCCAUAGUGGUCU | 1420 | 47886 | HCVa:(140)U23 siRNA stab09 active | B CCGGGAGAGCCAUAGUGGUTT B | 2122 |
| 157 | UGGUCUGCGGAACCGGUGAGUAC | 1426 | 47887 | HCVa:(157)U23 siRNA stab09 active | B GUCUGCGGAACCGGUGAGUTT B | 2123 |
| 303 | UGCCUGAUAGGGUGCUUGCGAGU | 1410 | 47888 | HCVa:(303)U23 siRNA stab09 active | B CCUGAUAGGGUGCUUGCGATT B | 2124 |
| 329 | CCGGGAGGUCUCGUAGACCGUGC | 1419 | 47889 | HCVa:(329)U23 siRNA stab09 active | B GGGAGGUCUCGUAGACCGUTT B | 2125 |
| 73 | GUCUUCACGCAGAAAGCGUCUAG | 2017 | 47890 | HCVa:(73)L21 siRNA stab10 active | AGACGCUUUCUGCGUGAAGTsT | 2126 |
| 86 | AAGCGUCUAGCCAUGGCGUUAGU | 2018 | 47891 | HCVa:(86)L21 siRNA stab10 active | UAACGCCAUGGCUAGACGCTsT | 2127 |
| 140 | UCCCGGGAGAGCCAUAGUGGUCU | 1420 | 47892 | HCVa:(140)L21 siRNA stab10 active | ACCACUAUGGCUCUCCCGGTsT | 2128 |
| 157 | UGGUCUGCGGAACCGGUGAGUAC | 1426 | 47893 | HCVa:(157)L21 siRNA stab10 active | ACUCACCGGUUCCGCAGACTsT | 2129 |
| 303 | UGCCUGAUAGGGUGCUUGCGAGU | 1410 | 47894 | HCVa:(303)L21 siRNA stab10 active | UCGCAAGCACCCUAUCAGGTsT | 2130 |
| 329 | CCGGGAGGUCUCGUAGACCGUGC | 1419 | 47895 | HCVa:(329)L21 siRNA stab10 active | ACGGUCUACGAGACCUCCCTsT | 2131 |
| 73 | GUCUUCACGCAGAAAGCGUCUAG | 2017 | 47896 | HCVa:(73)L21 siRNA stab25 active | AGAcGcuuucuGcGuGAAGTsT | 2132 |
| 86 | AAGCGUCUAGCCAUGGCGUUAGU | 2018 | 47897 | HCVa:(86)L21 siRNA stab25 active | uAAcGccAuGGcuAGAcGcTsT | 2133 |
| 140 | UCCCGGGAGAGCCAUAGUGGUCU | 1420 | 47898 | HCVa:(140)L21 siRNA stab25 active | AccAcuAuGGcucucccGGTsT | 2134 |
| 157 | UGGUCUGCGGAACCGGUGAGUAC | 1426 | 47899 | HCVa:(157)L21 siRNA stab25 active | AcucAccGGuuccGcAGAcTsT | 2135 |
| 303 | UGCCUGAUAGGGUGCUUGCGAGU | 1410 | 47900 | HCVa:(303)L21 siRNA stab25 active | ucGcAAGcAcccuAucAGGTsT | 2136 |
| 329 | CCGGGAGGUCUCGUAGACCGUGC | 1419 | 47901 | HCVa:(329)L21 siRNA stab25 active | AcGGucuAcGAGAccucccTsT | 2137 |
| 316 | CCCCGGGAGGUCUCGUAGACCGU | 1417 | 50721 | HCVa:(316)U23 siRNA stab07iB19 active | B cc*GGGAGG*ucuc*G*u*AGA*cBTT B | 2138 |
| 293 | GCCUGAUAGGGUGCUUGCGAGUG | 1444 | 50722 | HCVa:(293)U23 siRNA stab07iB19 active | B cu*GA*u*AGGG*u*G*cuu*G*c*GA*BTT B | 2139 |
| 316 | CCCCGGGAGGUCUCGUAGACCGU | 1417 | 50723 | HCVa:(316)L21 siRNA stab36iB19 active | GGUcuAcGAGAccucccGBGG | 2140 |
| 293 | GCCUGAUAGGGUGCUUGCGAGUG | 1444 | 50724 | HCVa:(293)L21 siRNA stab36iB19 active | CUCGcAAGcAcccuAucABGC | 2141 |

TABLE III-continued

HCV Synthetic Modified siNA Constructs

| Target Pos | Target | Seq ID | Cmpd# | Aliases | Sequence | Seq ID |
|---|---|---|---|---|---|---|
| 316 | CCCCGGGAGGUCUCGUAGACCGU | 1417 | 50725 | HCVa:(316)U23 siRNA stab07iB1 active | B BcGGGAGGucucGuAGAccTT B | 2142 |
| 293 | GCCUGAUAGGGUGCUUGCGAGUG | 1444 | 50726 | HCVa:(293)U23 siRNA stab07iB1 active | B BuGAuAGGGuGcuuGcGAGTT B | 2143 |
| 316 | CCCCGGGAGGUCUCGUAGACCGU | 1417 | 50727 | HCVa:(316)L21 siRNA stab36iB1 active | B GUcuAcGAGAccucccGGGG | 2144 |
| 293 | GCCUGAUAGGGUGCUUGCGAGUG | 1444 | 50728 | HCVa:(293)L21 siRNA stab36iB1 active | B UCGcAAGcAcccuAucAGGC | 2145 |
| 316 | CCCCGGGAGGUCUCGUAGACCGU | 1417 | 50729 | HCVa:(316)U23 siRNA stab07iB9 active | B ccGGGAGGBcucGuAGAccTT B | 2146 |
| 293 | GCCUGAUAGGGUGCUUGCGAGUG | 1444 | 50730 | HCVa:(293)U23 siRNA stab07iB9 active | B cuGAuAGGBuGcuuGcGAGTT B | 2147 |
| 316 | CCCCGGGAGGUCUCGUAGACCGU | 1417 | 50731 | HCVa:(316)L21 siRNA stab36iB9 active | GGUcuAcGBGAccucccGGGG | 2148 |
| 293 | GCCUGAUAGGGUGCUUGCGAGUG | 1444 | 50732 | HCVa:(293)L21 siRNA stab36iB9 active | CUCGcAAGBAcccuAucAGGC | 2149 |

Uppercase = ribonucleotide
u = 2'-deoxy-2'-fluoro uridine
c = 2'-deoxy-2'-fluoro cytidine
g = 2'-deoxy-2'-fluoro guanosine
a = 2'-deoxy-2'-fluoro adenosine
T = thymidine
B = inverted deoxy abasic
s = phosphorothioate linkage
A = deoxy Adenosine
G = deoxy Guanosine
U = deoxy Uridine
C = deoxy Cytidine
G = 2'-O-methyl Guanosine
A = 2'-O-methyl Adenosine
C = 2'-O-methyl Cytidine
U = 2'-O-methyl Uridine
L = hegS = hexethelyne glycol
spacer; spacer-18 (Glen Research 10-1918-xx)
p = terminal phosphate

TABLE IV

Non-limiting examples of Stabilization Chemistries for chemically modified siNA constructs

| Chemistry | pyrimidine | Purine | cap | p = S | Strand |
|---|---|---|---|---|---|
| "Stab 00" | Ribo | Ribo | TT at 3'-ends | — | S/AS |
| "Stab 1" | Ribo | Ribo | — | 5 at 5'-end 1 at 3'-end | S/AS |
| "Stab 2" | Ribo | Ribo | — | All linkages | Usually AS |
| "Stab 3" | 2'-fluoro | Ribo | — | 4 at 5'-end 4 at 3'-end | Usually S |
| "Stab 4" | 2'-fluoro | Ribo | 5' and 3'-ends | — | Usually S |
| "Stab 5" | 2'-fluoro | Ribo | — | 1 at 3'-end | Usually AS |
| "Stab 6" | 2'-O-Methyl | Ribo | 5' and 3'-ends | — | Usually S |
| "Stab 7" | 2'-fluoro | 2'-deoxy | 5' and 3'-ends | — | Usually S |
| "Stab 8" | 2'-fluoro | 2'-O-Methyl | — | 1 at 3'-end | S/AS |
| "Stab 9" | Ribo | Ribo | 5' and 3'-ends | — | Usually S |
| "Stab 10" | Ribo | Ribo | — | 1 at 3'-end | Usually AS |
| "Stab 11" | 2'-fluoro | 2'-deoxy | — | 1 at 3'-end | Usually AS |
| "Stab 12" | 2'-fluoro | LNA | 5' and 3'-ends | | Usually S |
| "Stab 13" | 2'-fluoro | LNA | | 1 at 3'-end | Usually AS |
| "Stab 14" | 2'-fluoro | 2'-deoxy | | 2 at 5'-end 1 at 3'-end | Usually AS |
| "Stab 15" | 2'-deoxy | 2'-deoxy | | 2 at 5'-end 1 at 3'-end | Usually AS |
| "Stab 16" | Ribo | 2'-O-Methyl | 5' and 3'-ends | | Usually S |
| "Stab 17" | 2'-O-Methyl | 2'-O-Methyl | 5' and 3'-ends | | Usually S |
| "Stab 18" | 2'-fluoro | 2'-O-Methyl | 5' and 3'-ends | | Usually S |
| "Stab 19" | 2'-fluoro | 2'-O-Methyl | 3'-end | | S/AS |
| "Stab 20" | 2'-fluoro | 2'-deoxy | 3'-end | | Usually AS |
| "Stab 21" | 2'-fluoro | Ribo | 3'-end | | Usually AS |
| "Stab 22" | Ribo | Ribo | 3'-end | | Usually AS |
| "Stab 23" | 2'-fluoro* | 2'-deoxy* | 5' and 3'-ends | | Usually S |
| "Stab 24" | 2'-fluoro* | 2'-O-Methyl* | — | 1 at 3'-end | S/AS |
| "Stab 25" | 2'-fluoro* | 2'-O-Methyl* | — | 1 at 3'-end | S/AS |
| "Stab 26" | 2'-fluoro* | 2'-O-Methyl* | — | | S/AS |
| "Stab 27" | 2'-fluoro* | 2'-O-Methyl* | 3'-end | | S/AS |
| "Stab 28" | 2'-fluoro* | 2'-O-Methyl* | 3'-end | | S/AS |
| "Stab 29" | 2'-fluoro* | 2'-O-Methyl* | | 1 at 3'-end | S/AS |
| "Stab 30" | 2'-fluoro* | 2'-O-Methyl* | | | S/AS |
| "Stab 31" | 2'-fluoro* | 2'-O-Methyl* | 3'-end | | S/AS |
| "Stab 32" | 2'-fluoro | 2'-O-Methyl | | | S/AS |
| "Stab 33" | 2'-fluoro | 2'-deoxy* | 5' and 3'-ends | — | Usually S |
| "Stab 34" | 2'-fluoro | 2'-O-Methyl* | 5' and 3'-ends | | Usually S |
| "Stab 35" | 2'-fluoro** | 2'-O-Methyl** | | | Usually AS |
| "Stab 36" | 2'-fluoro** | 2'-O-Methyl** | | | Usually AS |
| "Stab 3F" | 2'-OCF3 | Ribo | — | 4 at 5'-end 4 at 3'-end | Usually S |
| "Stab 4F" | 2'-OCF3 | Ribo | 5' and 3'-ends | — | Usually S |
| "Stab 5F" | 2'-OCF3 | Ribo | — | 1 at 3'-end | Usually AS |
| "Stab 7F" | 2'-OCF3 | 2'-deoxy | 5' and 3'-ends | — | Usually S |
| "Stab 8F" | 2'-OCF3 | 2'-O-Methyl | — | 1 at 3'-end | S/AS |
| "Stab 11F" | 2'-OCF3 | 2'-deoxy | — | 1 at 3'-end | Usually AS |
| "Stab 12F" | 2'-OCF3 | LNA | 5' and 3'-ends | | Usually S |
| "Stab 13F" | 2'-OCF3 | LNA | | 1 at 3'-end | Usually AS |

TABLE IV-continued

Non-limiting examples of Stabilization Chemistries for chemically modified siNA constructs

| Chemistry | pyrimidine | Purine | cap | p = S | Strand |
|---|---|---|---|---|---|
| "Stab 14F" | 2'-OCF3 | 2'-deoxy | | 2 at 5'-end 1 at 3'-end | Usually AS |
| "Stab 15F" | 2'-OCF3 | 2'-deoxy | | 2 at 5'-end 1 at 3'-end | Usually AS |
| "Stab 18F" | 2'-OCF3 | 2'-O-Methyl | 5' and 3'-ends | | Usually S |
| "Stab 19F" | 2'-OCF3 | 2'-O-Methyl | 3'-end | | S/AS |
| "Stab 20F" | 2'-OCF3 | 2'-deoxy | 3'-end | | Usually AS |
| "Stab 21F" | 2'-OCF3 | Ribo | 3'-end | | Usually AS |
| "Stab 23F" | 2'-OCF3* | 2'-deoxy* | 5' and 3'-ends | | Usually S |
| "Stab 24F" | 2'-OCF3* | 2'-O-Methyl* | — | 1 at 3'-end | S/AS |
| "Stab 25F" | 2'-OCF3* | 2'-O-Methyl* | — | 1 at 3'-end | S/AS |
| "Stab 26F" | 2'-OCF3* | 2'-O-Methyl* | — | | S/AS |
| "Stab 27F" | 2'-OCF3* | 2'-O-Methyl* | 3'-end | | S/AS |
| "Stab 28F" | 2'-OCF3* | 2'-O-Methyl* | 3'-end | | S/AS |
| "Stab 29F" | 2'-OCF3* | 2'-O-Methyl* | | 1 at 3'-end | S/AS |
| "Stab 30F" | 2'-OCF3* | 2'-O-Methyl* | | | S/AS |
| "Stab 31F" | 2'-OCF3* | 2'-O-Methyl* | 3'-end | | S/AS |
| "Stab 32F" | 2'-OCF3 | 2'-O-Methyl | | | S/AS |
| "Stab 33F" | 2'-OCF3 | 2'-deoxy* | 5' and 3'-ends | — | Usually S |
| "Stab 34F" | 2'-OCF3 | 2'-O-Methyl* | 5' and 3'-ends | | Usually S |
| "Stab 35F" | 2'-OCF3*† | 2'-O-Methyl*† | | | Usually AS |
| "Stab 36F" | 2'-OCF3*† | 2'-O-Methyl*† | | | Usually AS |

CAP = any terminal cap, see for example FIG. 10.

All Stab 00-34 chemistries can comprise 3'-terminal thymidine (TT) residues

All Stab 00-34 chemistries typically comprise about 21 nucleotides, but can vary as described herein.

All Stab 00-36 chemistries can also include a single ribonucleotide in the sense or passenger strand at the 11th base paired position of the double stranded nucleic acid duplex as determined from the 5'-end of the antisense or guide strand (see FIG. 6C)

S = sense strand

AS = antisense strand

*Stab 23 has a single ribonucleotide adjacent to 3'-CAP

*Stab 24 and Stab 28 have a single ribonucleotide at 5'-terminus

*Stab 25, Stab 26, Stab 27, Stab 35 and Stab 36 have three ribonucleotides at 5'-terminus

*Stab 29, Stab 30, Stab 31, Stab 33, and Stab 34 any purine at first three nucleotide positions from 5'-terminus are ribonucleotides p = phosphorothioate linkage †Stab 35 has 2'-O-methyl U at 3'-overhangs and three ribonucleotides at 5'-terminus †Stab 36 has 2'-O-methyl overhangs that are complementary to the target sequence (naturually occurring overhangs) and three ribonucleotides at 5'-terminus

TABLE V

| Reagent | Equivalents | Amount | Wait Time* DNA | Wait Time* 2'-O-methyl | Wait Time* RNA |
|---|---|---|---|---|---|
| A. 2.5 μmol Synthesis Cycle ABI 394 Instrument | | | | | |
| Phosphoramidites | 6.5 | 163 μL | 45 sec | 2.5 min | 7.5 min |
| S-Ethyl Tetrazole | 23.8 | 238 μL | 45 sec | 2.5 min | 7.5 min |
| Acetic Anhydride | 100 | 233 μL | 5 sec | 5 sec | 5 sec |
| N-Methyl Imidazole | 186 | 233 μL | 5 sec | 5 sec | 5 sec |
| TCA | 176 | 2.3 mL | 21 sec | 21 sec | 21 sec |
| Iodine | 11.2 | 1.7 mL | 45 sec | 45 sec | 45 sec |
| Beaucage | 12.9 | 645 μL | 100 sec | 300 sec | 300 sec |
| Acetonitrile | NA | 6.67 mL | NA | NA | NA |

TABLE V-continued

B. 0.2 μmol Synthesis Cycle ABI 394 Instrument

| Reagent | | | | | |
|---|---|---|---|---|---|
| Phosphoramidites | 15 | 31 μL | 45 sec | 233 sec | 465 sec |
| S-Ethyl Tetrazole | 38.7 | 31 μL | 45 sec | 233 min | 465 sec |
| Acetic Anhydride | 655 | 124 μL | 5 sec | 5 sec | 5 sec |
| N-Methyl Imidazole | 1245 | 124 μL | 5 sec | 5 sec | 5 sec |
| TCA | 700 | 732 μL | 10 sec | 10 sec | 10 sec |
| Iodine | 20.6 | 244 μL | 15 sec | 15 sec | 15 sec |
| Beaucage | 7.7 | 232 μL | 100 sec | 300 sec | 300 sec |
| Acetonitrile | NA | 2.64 mL | NA | NA | NA |

C. 0.2 μmol Synthesis Cycle 96 well Instrument

| Reagent | Equivalents: DNA/2'-O-methyl/Ribo | Amount: DNA/2'-O-methyl/Ribo | Wait Time* DNA | Wait Time* 2'-O-methyl | Wait Time* Ribo |
|---|---|---|---|---|---|
| Phosphoramidites | 22/33/66 | 40/60/120 μL | 60 sec | 180 sec | 360 sec |
| S-Ethyl Tetrazole | 70/105/210 | 40/60/120 μL | 60 sec | 180 mim | 360 sec |
| Acetic Anhydride | 265/265/265 | 50/50/50 μL | 10 sec | 10 sec | 10 sec |
| N-Methyl Imidazole | 502/502/502 | 50/50/50 μL | 10 sec | 10 sec | 10 sec |
| TCA | 238/475/475 | 250/500/500 μL | 15 sec | 15 sec | 15 sec |
| Iodine | 6.8/6.8/6.8 | 80/80/80 μL | 30 sec | 30 sec | 30 sec |
| Beaucage | 34/51/51 | 80/120/120 μL | 100 sec | 200 sec | 200 sec |
| Acetonitrile | NA | 1150/1150/1150 μL | NA | NA | NA |

Wait time does not include contact time during delivery.
Tandem synthesis untilizes double coupling of linker molecule

TABLE VI

Lipid Nanoparticle (LNP) Formulations

| Formulation # | Composition | Molar Ratio |
|---|---|---|
| L051 | CLinDMA/DSPC/Chol/PEG-n-DMG | 48/40/10/2 |
| L053 | DMOBA/DSPC/Chol/PEG-n-DMG | 30/20/48/2 |
| L054 | DMOBA/DSPC/Chol/PEG-n-DMG | 50/20/28/2 |
| L069 | CLinDMA/DSPC/Cholesterol/PEG-Cholesterol | 48/40/10/2 |
| L073 | pCLinDMA or CLin DMA/DMOBA/DSPC/Chol/PEG-n-DMG | 25/25/20/28/2 |
| L077 | eCLinDMA/DSPC/Cholesterol/2KPEG-Chol | 48/40/10/2 |
| L080 | eCLinDMA/DSPC/Cholesterol/2KPEG-DMG | 48/40/10/2 |
| L082 | pCLinDMA/DSPC/Cholesterol/2KPEG-DMG | 48/40/10/2 |
| L083 | pCLinDMA/DSPC/Cholesterol/2KPEG-Chol | 48/40/10/2 |
| L086 | CLinDMA/DSPC/Cholesterol/2KPEG-DMG/Linoleyl alcohol | 43/38/10/2/7 |
| L061 | DMLBA/Cholesterol/2KPEG-DMG | 52/45/3 |
| L060 | DMOBA/Cholesterol/2KPEG-DMG N/P ratio of 5 | 52/45/3 |
| L097 | DMLBA/DSPC/Cholesterol/2KPEG-DMG | 50/20/28 |
| L098 | DMOBA/Cholesterol/2KPEG-DMG, N/P ratio of 3 | 52/45/3 |
| L099 | DMOBA/Cholesterol/2KPEG-DMG, N/P ratio of 4 | 52/45/3 |
| L100 | DMOBA/DOBA/3% PEG-DMG, N/P ratio of 3 | 52/45/3 |
| L101 | DMOBA/Cholesterol/2KPEG-Cholesterol | 52/45/3 |
| L102 | DMOBA/Cholesterol/2KPEG-Cholesterol, N/P ratio of 5 | 52/45/3 |
| L103 | DMLBA/Cholesterol/2KPEG-Cholesterol | 52/45/3 |
| L104 | CLinDMA/DSPC/Cholesterol/2KPEG-cholesterol/Linoleyl alcohol | 43/38/10/2/7 |
| L105 | DMOBA/Cholesterol/2KPEG-Chol, N/P ratio of 2 | 52/45/3 |
| L106 | DMOBA/Cholesterol/2KPEG-Chol, N/P ratio of 3 | 67/30/3 |
| L107 | DMOBA/Cholesterol/2KPEG-Chol, N/P ratio of 1.5 | 52/45/3 |
| L108 | DMOBA/Cholesterol/2KPEG-Chol, N/P ratio of 2 | 67/30/3 |
| L109 | DMOBA/DSPC/Cholesterol/2KPEG-Chol, N/P ratio of 2 | 50/20/28/2 |
| L110 | DMOBA/Cholesterol/2KPEG-DMG, N/P ratio of 1.5 | 52/45/3 |
| L111 | DMOBA/Cholesterol/2KPEG-DMG, N/P ratio of 1.5 | 67/30/3 |
| L112 | DMLBA/Cholesterol/2KPEG-DMG, N/P ratio of 1.5 | 52/45/3 |
| L113 | DMLBA/Cholesterol/2KPEG-DMG, N/P ratio of 1.5 | 67/30/3 |
| L114 | DMOBA/Cholesterol/2KPEG-DMG, N/P ratio of 2 | 52/45/3 |
| L115 | DMOBA/Cholesterol/2KPEG-DMG, N/P ratio of 2 | 67/30/3 |
| L116 | DMLBA/Cholesterol/2KPEG-DMG, N/Pratio of 2 | 52/45/3 |
| L117 | DMLBA/Cholesterol/2KPEG-DMG, N/P ratio of 2 | 52/45/3 |
| L118 | LinCDMA/DSPC/Cholesterol/2KPEG-DMG/Linoleyl alcohol, N/P ratio of 2.85 | 43/38/10/2/7 |
| L121 | 2-CLIM/DSPC/Cholesterol/2KPEG-DMG/, N/P ratio of 3 | 48/40/10/2 |
| L122 | 2-CLIM/Cholesterol/2KPEG-DMG/, N/P ratio of 3 | 68/30/2 |
| L123 | CLinDMA/DSPC/Cholesterol/2KPEG-DMG/Linoleyl alcohol, N/P ratio of 2.85 | 43/38/10/3/7 |
| L124 | CLinDMA/DSPC/Cholesterol/2KPEG-DMG/Linoleyl alcohol, N/P ratio of 2.85 | 43/36/10/4/7 |
| L130 | CLinDMA/DOPC/Chol/PEG-n-DMG, N/P ratio of 3 | 48/39/10/3 |
| L131 | DMLBA/Cholesterol/2KPEG-DMG, N/Pratio of 3 | 52/43/5 |
| L132 | DMOBA/Cholesterol/2KPEG-DMG, N/Pratio of 3 | 52/43/5 |
| L133 | CLinDMA/DOPC/Chol/PEG-n-DMG, N/P ratio of 3 | 48/40/10/2 |
| L134 | CLinDMA/DOPC/Chol/PEG-n-DMG, N/P ratio of 3 | 48/37/10/5 |
| L149 | COIM/DSPC/Cholesterol/2KPEG-DMG/, N/P ratio of 3 | 48/40/10/2 |

TABLE VI-continued

Lipid Nanoparticle (LNP) Formulations

| Formulation # | Composition | Molar Ratio |
|---|---|---|
| L155 | CLinDMA/DOPC/Cholesterol/2KPEG-DMG/Linoleyl alcohol, N/P ratio of 2.85 | 43/38/10/2/7 |
| L156 | CLinDMA/DOPC/Cholesterol/2KPEG-DMG, N/P ratio of 2.85 | 45/43/10/2 |
| L162 | CLinDMA/DOPC/Cholesterol/2KPEG-DMG, N/P ratio of 2.5 | 45/43/10/2 |
| L163 | CLinDMA/DOPC/Cholesterol/2KPEG-DMG, N/P ratio of 2 | 45/43/10/2 |
| L164 | CLinDMA/DOPC/Cholesterol/2KPEG-DMG, N/P ratio of 2.25 | 45/43/10/2 |
| L165 | CLinDMA/DOPC/Cholesterol/2KPEG-DMG, N/P ratio of 2.25 | 40/43/15/2 |
| L166 | CLinDMA/DOPC/Cholesterol/2KPEG-DMG, N/P ratio of 2.5 | 40/43/15/2 |
| L167 | CLinDMA/DOPC/Cholesterol/2KPEG-DMG, N/P ratio of 2 | 40/43/15/2 |
| L174 | CLinDMA/DSPC/DOPC/Cholesterol/2KPEG-DMG/Linoleyl alcohol, N/P ratio of 2.85 | 43/9/27/10/4/7 |
| L175 | CLinDMA/DSPC/DOPC/Cholesterol/2KPEG-DMG/Linoleyl alcohol, N/P ratio of 2.85 | 43/27/9/10/4/7 |
| L176 | CLinDMA/DOPC/Cholesterol/2KPEG-DMG/Linoleyl alcohol, N/P ratio of 2.85 | 43/38/10/4/7 |
| L180 | CLinDMA/DOPC/Cholesterol/2KPEG-DMG/Linoleyl alcohol, N/P ratio of 2.25 | 43/38/10/4/7 |
| L181 | CLinDMA/DOPC/Cholesterol/2KPEG-DMG/Linoleyl alcohol, N/P ratio of 2 | 43/38/10/4/7 |
| L182 | CLinDMA/DOPC/Cholesterol/2KPEG-DMG, N/P ratio of 2.25 | 45/41/10/4 |

N/P ratio = Nitrogen:Phosphorous ratio between cationic lipid and nucleic acid

The 2KPEG utilized is PEG2000, a polydispersion which can typically vary from ~1500 to ~3000 Da (i.e., where PEG(n) is about 33 to about 67, or on average ~45).

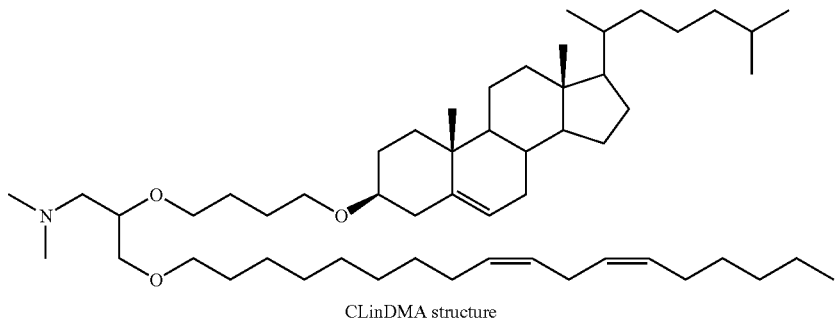

CLinDMA structure

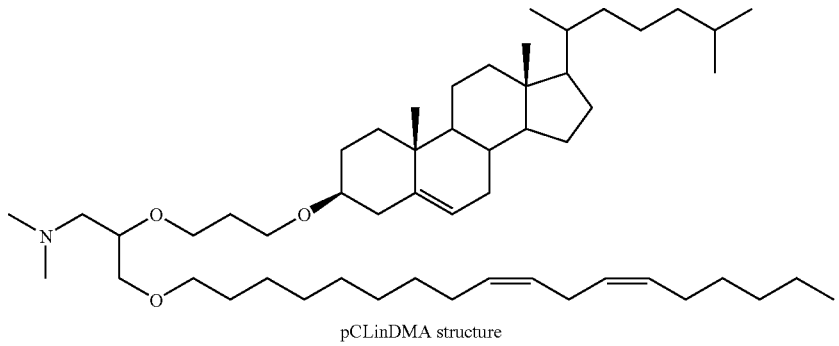

pCLinDMA structure

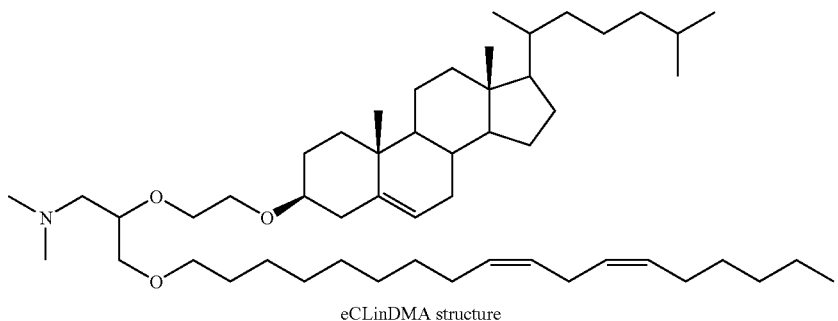

eCLinDMA structure

-continued
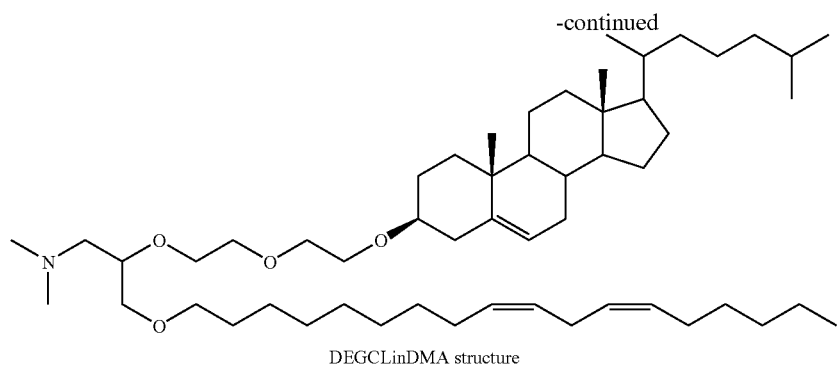
DEGCLinDMA structure
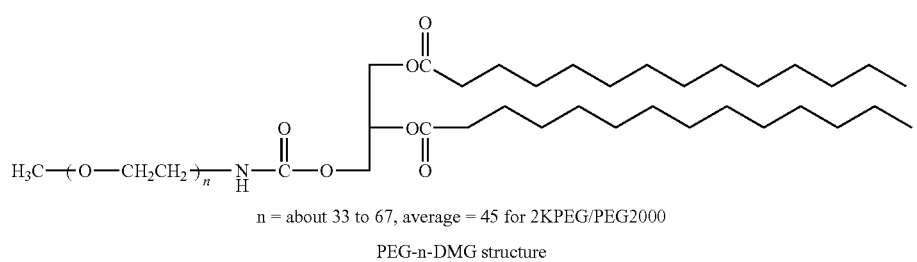
n = about 33 to 67, average = 45 for 2KPEG/PEG2000
PEG-n-DMG structure
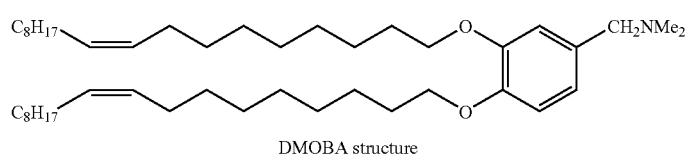
DMOBA structure
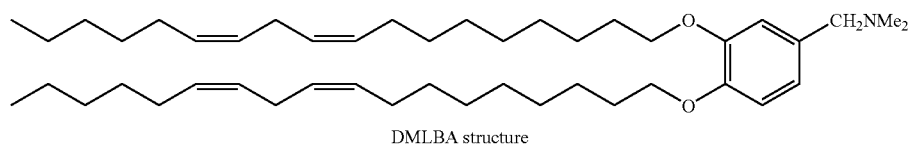
DMLBA structure
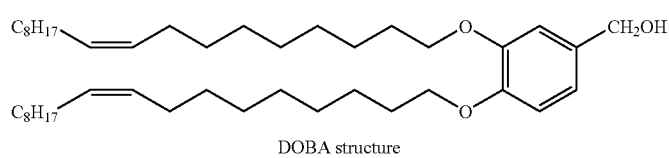
DOBA structure
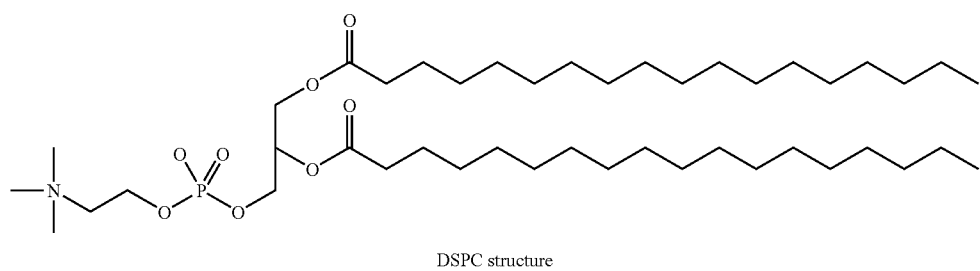
DSPC structure
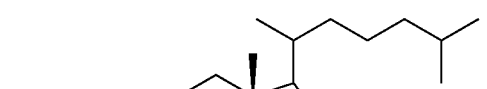
Cholesterol structure

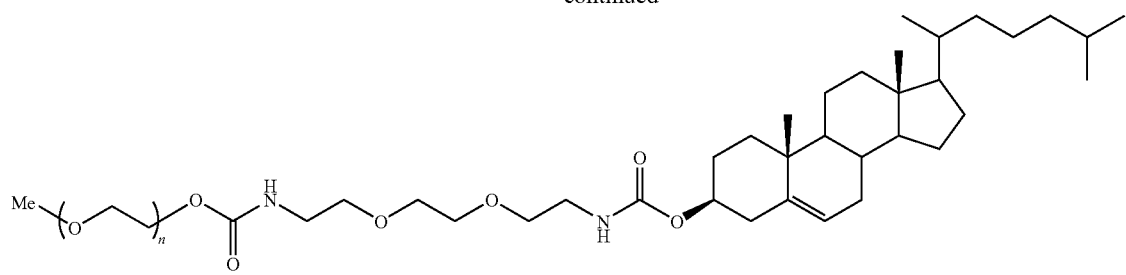
2KPEG-Cholesterol structure
n = about 33 to 67, average = 45 for 2KPEG/PEG2000
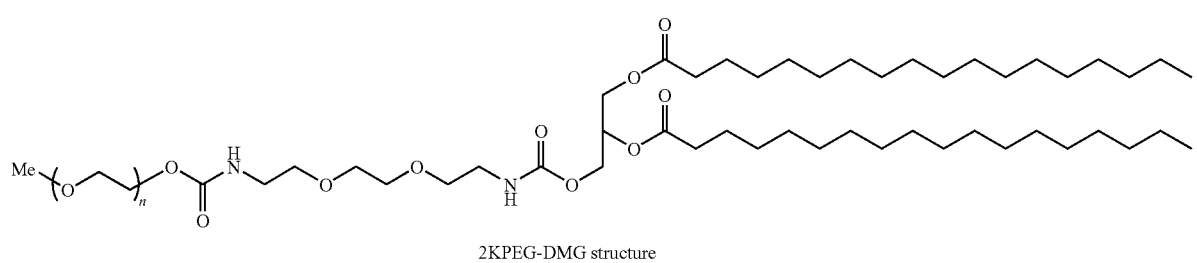
2KPEG-DMG structure
n = about 33 to 67, average = 45 for 2KPEG/PEG2000
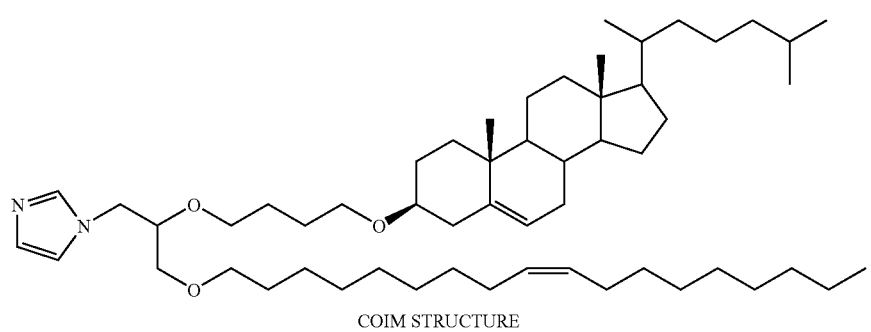
COIM STRUCTURE
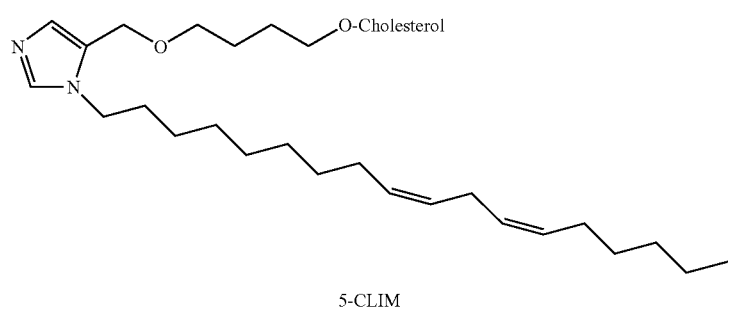
5-CLIM
5-CLIM and 2-CLIM STRUCTURE
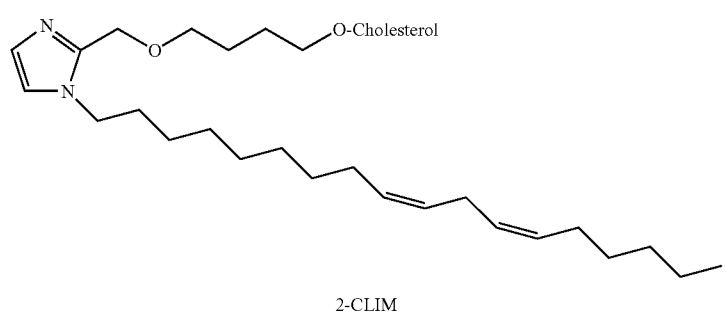
2-CLIM

TABLE VII

Table VII: Sirna algorithm describing patterns with their relative score for predicting hyper-active siNAs.

| Description of pattern | Pattern # | Score |
|---|---|---|
| G or C at position 1 | 1 | 5 |
| A or U at position 19 | 2 | 10 |
| A/U rich between position 15-19 | 3 | 10 |
| String of 4 Gs or 4 Cs (not preferred) | 4 | −100 |
| G/C rich between position 1-5 | 5 | 10 |
| A or U at position 18 | 6 | 5 |
| A or U at position 10 | 7 | 10 |
| G at position 13 (not preferred) | 8 | −3 |
| A at position 13 | 9 | 3 |
| G at position 9 (not preferred) | 10 | −3 |
| A at position 9 | 11 | 3 |
| A or U at position 14 | 12 | 10 |

All the positions given are for the sense strand of 19-mer siNA.

TABLE VIII

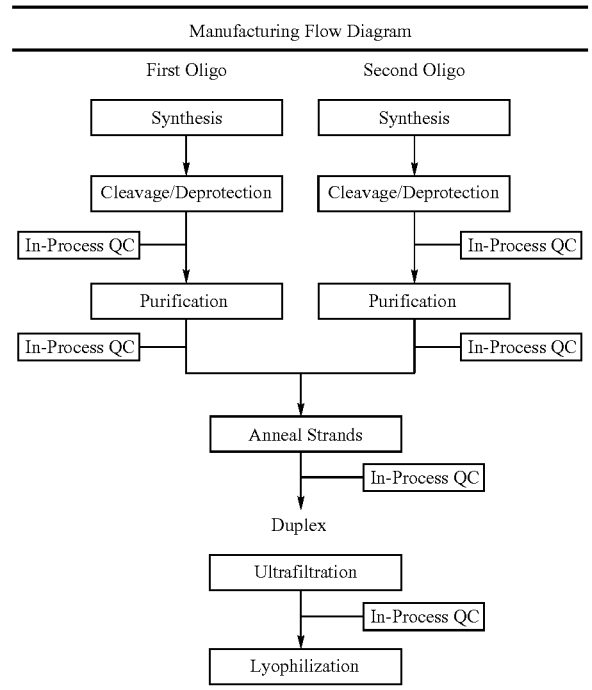

Manufacturing Flow Diagram

TABLE IX

Analtical Methods for siNA characterization

| Test Name | Test Method | Acceptance Criteria | Results |
|---|---|---|---|
| Identity Tests | | | |
| ID Oligonucleotide: Main Peak | HPLC | Retention time of sample and standard main peaks compare favorably | |
| Molecular Weight | MS | MW = N ± 3 amu (sodium free) | amu |
| Melting Temperature | UV | monitored | ° C. |
| Assay Tests | | | |
| Oligonucleotide Content | UV | NLT 800 µg/mg | µg/mg |
| Purity Tests | | | |
| Oligonucleotide Duplex: Main Peak | HPLC | NLT 80.0% Main Peak | % |
| Oligonucleotide: Total Other Related Substances | HPLC | monitored | % |
| Oligonucleotide Single Strand | HPLC | Identify strand and quantity, monitored | % |
| Oligonucleotide Duplex: Main Peak | HPLC | monitored | % |
| Other Tests | | | |
| Physical Appearance | Visual | White to pale yellow powder | |
| pH | pH | monitored | |
| Bacterial Endotoxins | LAL | <dose dependent> | EU/mg |
| Aerobic Bioburden | Microbiology | NMT 500 CFU/gram | CFU/gram |
| Residual Acetonitrile | GC | NMT 410 ppm | ppm |
| Water Content | Karl Fischer | monitored | % |

TABLE IX-continued

Analtical Methods for siNA characterization

| Test Name | Test Method | Acceptance Criteria | Results | |
|---|---|---|---|---|
| Metals Content | ICP | monitored | Aluminum = | _____ppm |
| | | | Nickel = | _____ppm |
| | | | Chromium = | _____ppm |
| | | | Molybdenum = | _____ppm |
| | | | Copper = | _____ppm |
| | | | Iron = | _____ppm |
| | | | Magnesium = | _____ppm |
| Ions Content | AA and Ion Chromatography | monitored | Sodium = | _____% |
| | | | Chloride = | _____ppm |
| | | | Phosphate = | _____ppm |

SEQUENCE LISTING (2177 sequences)

SEQ ID NO: 1 - RNA, 19 nt, Artificial Sequence
  Description of Artificial Sequence: Target Sequence/siNA sense region
gccccgggaggucucguag

SEQ ID NO: 2 - RNA, 19 nt, Artificial Sequence
  Description of Artificial Sequence: Target Sequence/siNA sense region
ugugguacugccugauagg

SEQ ID NO: 3 - RNA, 19 nt, Artificial Sequence
  Description of Artificial Sequence: Target Sequence/siNA sense region
uugugguacugccugauag

SEQ ID NO: 4 - RNA, 19 nt, Artificial Sequence
  Description of Artificial Sequence: Target Sequence/siNA sense region
ccccgggaggucucguaga

SEQ ID NO: 5 - RNA, 19 nt, Artificial Sequence
  Description of Artificial Sequence: Target Sequence/siNA sense region
gugguacugccugauaggg

SEQ ID NO: 6 - RNA, 19 nt, Artificial Sequence
  Description of Artificial Sequence: Target Sequence/siNA sense region
cugccugauagggugcuug

SEQ ID NO: 7 - RNA, 19 nt, Artificial Sequence
  Description of Artificial Sequence: Target Sequence/siNA sense region
ccuugugguacugccugau

SEQ ID NO: 8 - RNA, 19 nt, Artificial Sequence
  Description of Artificial Sequence: Target Sequence/siNA sense region
gcgaaaggccuugugguac

SEQ ID NO: 9 - RNA, 19 nt, Artificial Sequence
  Description of Artificial Sequence: Target Sequence/siNA sense region
uacugccugauagggugcu

SEQ ID NO: 10 - RNA, 19 nt, Artificial Sequence
  Description of Artificial Sequence: Target Sequence/siNA sense region
gguacugccugauagggug

SEQ ID NO: 11 - RNA, 19 nt, Artificial Sequence
  Description of Artificial Sequence: Target Sequence/siNA sense region
aaaggccuugugguacugc

SEQ ID NO: 12 - RNA, 19 nt, Artificial Sequence
  Description of Artificial Sequence: Target Sequence/siNA sense region
aaggccuugugguacugcc

SEQ ID NO: 13 - RNA, 19 nt, Artificial Sequence
  Description of Artificial Sequence: Target Sequence/siNA sense region
cuugugguacugccugaua

SEQ ID NO: 14 - RNA, 19 nt, Artificial Sequence
  Description of Artificial Sequence: Target Sequence/siNA sense region
aggccuugugguacugccu

SEQ ID NO: 15 - RNA, 19 nt, Artificial Sequence
  Description of Artificial Sequence: Target Sequence/siNA sense region
guacugccugauagggugc

SEQ ID NO: 16 - RNA, 19 nt, Artificial Sequence
  Description of Artificial Sequence: Target Sequence/siNA sense region
acugccugauagggugcuu

SEQ ID NO: 17 - RNA, 19 nt, Artificial Sequence
  Description of Artificial Sequence: Target Sequence/siNA sense region
cuugcgagugccccgggag

SEQ ID NO: 18 - RNA, 19 nt, Artificial Sequence
  Description of Artificial Sequence: Target Sequence/siNA sense region
cugauagggugcuugcgag

SEQ ID NO: 19 - RNA, 19 nt, Artificial Sequence
  Description of Artificial Sequence: Target Sequence/siNA sense region
uugcgagugccccgggagg

SEQ ID NO: 20 - RNA, 19 nt, Artificial Sequence
  Description of Artificial Sequence: Target Sequence/siNA sense region
ccugauagggugcuugcga

SEQ ID NO: 21 - RNA, 19 nt, Artificial Sequence
  Description of Artificial Sequence: Target Sequence/siNA sense region
ggccuugugguacugccug

SEQ ID NO: 22 - RNA, 19 nt, Artificial Sequence
  Description of Artificial Sequence: Target Sequence/siNA sense region
gcuugcgagugccccggga

SEQ ID NO: 23 - RNA, 19 nt, Artificial Sequence
  Description of Artificial Sequence: Target Sequence/siNA sense region
ugccugauagggugcuugc

SEQ ID NO: 24 - RNA, 19 nt, Artificial Sequence
  Description of Artificial Sequence: Target Sequence/siNA sense region
gaaaggccuugugguacug

SEQ ID NO: 25 - RNA, 19 nt, Artificial Sequence
  Description of Artificial Sequence: Target Sequence/siNA sense region
gccugauagggugcuugcg

SEQ ID NO: 26 - RNA, 19 nt, Artificial Sequence
  Description of Artificial Sequence: Target Sequence/siNA sense region
cgaaaggccuugugguacu

SEQ ID NO: 27 - RNA, 19 nt, Artificial Sequence
  Description of Artificial Sequence: Target Sequence/siNA sense region
gccuugugguacugccuga

SEQ ID NO: 28 - RNA, 19 nt, Artificial Sequence
  Description of Artificial Sequence: Target Sequence/siNA sense region
gagugccccgggaggucuc

SEQ ID NO: 29 - RNA, 19 nt, Artificial Sequence
  Description of Artificial Sequence: Target Sequence/siNA sense region
cccgggaggucucguagac

SEQ ID NO: 30 - RNA, 19 nt, Artificial Sequence
  Description of Artificial Sequence: Target Sequence/siNA sense region
ugcgagugccccgggaggu

SEQ ID NO: 31 - RNA, 19 nt, Artificial Sequence
  Description of Artificial Sequence: Target Sequence/siNA sense region
ugguacugccugauagggu

SEQ ID NO: 32 - RNA, 19 nt, Artificial Sequence
  Description of Artificial Sequence: Target Sequence/siNA sense region
ccggugaguacaccggaau

SEQ ID NO: 33 - RNA, 19 nt, Artificial Sequence
  Description of Artificial Sequence: Target Sequence/siNA sense region
gcgagugccccgggagguc

SEQ ID NO: 34 - RNA, 19 nt, Artificial Sequence
  Description of Artificial Sequence: Target Sequence/siNA sense region
cgagugccccgggaggucu

SEQ ID NO: 35 - RNA, 19 nt, Artificial Sequence
  Description of Artificial Sequence: Target Sequence/siNA sense region
ugccccgggaggucucgua

SEQ ID NO: 36 - RNA, 19 nt, Artificial Sequence
  Description of Artificial Sequence: Target Sequence/siNA sense region
gugccccgggaggucucgu

SEQ ID NO: 37 - RNA, 19 nt, Artificial Sequence
  Description of Artificial Sequence: Target Sequence/siNA sense region
agugccccgggaggucucg

SEQ ID NO: 38 - RNA, 19 nt, Artificial Sequence
  Description of Artificial Sequence: Target Sequence/siNA sense region
ccgggaggucucguagacc

SEQ ID NO: 39 - RNA, 19 nt, Artificial Sequence
  Description of Artificial Sequence: Target Sequence/siNA sense region
ugauagggugcuugcgagu

SEQ ID NO: 40 - RNA, 19 nt, Artificial Sequence
  Description of Artificial Sequence: Target Sequence/siNA sense region
gugcuugcgagugccccgg

SEQ ID NO: 41 - RNA, 19 nt, Artificial Sequence
  Description of Artificial Sequence: Target Sequence/siNA sense region
auagggugcuugcgagugc

SEQ ID NO: 42 - RNA, 19 nt, Artificial Sequence
  Description of Artificial Sequence: Target Sequence/siNA sense region
gggugcuugcgagugcccc

SEQ ID NO: 43 - RNA, 19 nt, Artificial Sequence
  Description of Artificial Sequence: Target Sequence/siNA sense region
cgggaggucucguagaccg

SEQ ID NO: 44 - RNA, 19 nt, Artificial Sequence
  Description of Artificial Sequence: Target Sequence/siNA sense region
gggaggucucguagaccgu

SEQ ID NO: 45 - RNA, 19 nt, Artificial Sequence
  Description of Artificial Sequence: Target Sequence/siNA sense region
gauagggugcuugcgagug

SEQ ID NO: 46 - RNA, 19 nt, Artificial Sequence
  Description of Artificial Sequence: Target Sequence/siNA sense region
ggaggucucguagaccgug

SEQ ID NO: 47 - RNA, 19 nt, Artificial Sequence
  Description of Artificial Sequence: Target Sequence/siNA sense region
agggugcuugcgagugccc

SEQ ID NO: 48 - RNA, 19 nt, Artificial Sequence
  Description of Artificial Sequence: Target Sequence/siNA sense region
ugcuugcgagugccccggg

SEQ ID NO: 49 - RNA, 19 nt, Artificial Sequence
  Description of Artificial Sequence: Target Sequence/siNA sense region
ggugcuugcgagugccccg

SEQ ID NO: 50 - RNA, 19 nt, Artificial Sequence
  Description of Artificial Sequence: Target Sequence/siNA sense region
uagggugcuugcgagugcc

SEQ ID NO: 51 - RNA, 19 nt, Artificial Sequence
  Description of Artificial Sequence: Target Sequence/siNA sense region
aggucucguagaccgugca

SEQ ID NO: 52 - RNA, 19 nt, Artificial Sequence
  Description of Artificial Sequence: Target Sequence/siNA sense region
gaggucucguagaccgugc

SEQ ID NO: 53 - RNA, 19 nt, Artificial Sequence
  Description of Artificial Sequence: Target Sequence/siNA sense region
ggaaccggugaguacaccg

SEQ ID NO: 54 - RNA, 19 nt, Artificial Sequence
  Description of Artificial Sequence: Target Sequence/siNA sense region
cggaaccggugaguacacc

SEQ ID NO: 55 - RNA, 19 nt, Artificial Sequence
  Description of Artificial Sequence: Target Sequence/siNA sense region
cggugaguacaccggaauu

SEQ ID NO: 56 - RNA, 19 nt, Artificial Sequence
  Description of Artificial Sequence: Target Sequence/siNA sense region
gcggaaccggugaguacac

SEQ ID NO: 57 - RNA, 19 nt, Artificial Sequence
  Description of Artificial Sequence: Target Sequence/siNA sense region
aaccggugaguacaccgga

SEQ ID NO: 58 - RNA, 19 nt, Artificial Sequence
  Description of Artificial Sequence: Target Sequence/siNA sense region
accggugaguacaccggaa

SEQ ID NO: 59 - RNA, 19 nt, Artificial Sequence
  Description of Artificial Sequence: Target Sequence/siNA sense region
cugcggaaccggugaguac

SEQ ID NO: 60 - RNA, 19 nt, Artificial Sequence
  Description of Artificial Sequence: Target Sequence/siNA sense region
gucugcggaaccggugagu

SEQ ID NO: 61 - RNA, 19 nt, Artificial Sequence
  Description of Artificial Sequence: Target Sequence/siNA sense region
gaaccggugaguacaccgg

SEQ ID NO: 62 - RNA, 19 nt, Artificial Sequence
  Description of Artificial Sequence: Target Sequence/siNA sense region
ugcggaaccggugaguaca

SEQ ID NO: 63 - RNA, 19 nt, Artificial Sequence
  Description of Artificial Sequence: Target Sequence/siNA sense region
ucugcggaaccggugagua

SEQ ID NO: 64 - RNA, 19 nt, Artificial Sequence
  Description of Artificial Sequence: Target Sequence/siNA sense region
gggagagccauaguggucu

SEQ ID NO: 65 - RNA, 19 nt, Artificial Sequence
  Description of Artificial Sequence: Target Sequence/siNA sense region
guggucugcggaaccggug

SEQ ID NO: 66 - RNA, 19 nt, Artificial Sequence
  Description of Artificial Sequence: Target Sequence/siNA sense region
ggucugcggaaccggugag

SEQ ID NO: 67 - RNA, 19 nt, Artificial Sequence
  Description of Artificial Sequence: Target Sequence/siNA sense region
cgggagagccauagugguc

SEQ ID NO: 68 - RNA, 19 nt, Artificial Sequence
  Description of Artificial Sequence: Target Sequence/siNA sense region
ccgggagagccauaguggu

SEQ ID NO: 69 - RNA, 19 nt, Artificial Sequence
  Description of Artificial Sequence: Target Sequence/siNA sense region
uggucugcggaaccgguga

SEQ ID NO: 70 - RNA, 19 nt, Artificial Sequence
  Description of Artificial Sequence: Target Sequence/siNA sense region
gugaguacaccggaauugc

SEQ ID NO: 71 - RNA, 19 nt, Artificial Sequence
  Description of Artificial Sequence: Target Sequence/siNA sense region
ugaguacaccggaauugcc

SEQ ID NO: 72 - RNA, 19 nt, Artificial Sequence
  Description of Artificial Sequence: Target Sequence/siNA sense region
ggugaguacaccggaauug

SEQ ID NO: 73 - RNA, 19 nt, Artificial Sequence
  Description of Artificial Sequence: Target Sequence/siNA sense region
gagccauaguggucugcgg

SEQ ID NO: 74 - RNA, 19 nt, Artificial Sequence
  Description of Artificial Sequence: Target Sequence/siNA sense region
agagccauaguggucugcg

SEQ ID NO: 75 - RNA, 19 nt, Artificial Sequence
  Description of Artificial Sequence: Target Sequence/siNA sense region
uaguggucugcggaaccgg

SEQ ID NO: 76 - RNA, 19 nt, Artificial Sequence
  Description of Artificial Sequence: Target Sequence/siNA sense region
auaguggucugcggaaccg

SEQ ID NO: 77 - RNA, 19 nt, Artificial Sequence
  Description of Artificial Sequence: Target Sequence/siNA sense region
gagagccauaguggucugc

SEQ ID NO: 78 - RNA, 19 nt, Artificial Sequence
  Description of Artificial Sequence: Target Sequence/siNA sense region
gccauaguggucugcggaa

SEQ ID NO: 79 - RNA, 19 nt, Artificial Sequence
  Description of Artificial Sequence: Target Sequence/siNA sense region
aguggucugcggaaccggu

SEQ ID NO: 80 - RNA, 19 nt, Artificial Sequence
  Description of Artificial Sequence: Target Sequence/siNA sense region
cauaguggucugcggaacc

SEQ ID NO: 81 - RNA, 19 nt, Artificial Sequence
  Description of Artificial Sequence: Target Sequence/siNA sense region
agccauaguggucugcgga

SEQ ID NO: 82 - RNA, 19 nt, Artificial Sequence
  Description of Artificial Sequence: Target Sequence/siNA sense region
ccauaguggucugcggaac

SEQ ID NO: 83 - RNA, 19 nt, Artificial Sequence
  Description of Artificial Sequence: Target Sequence/siNA sense region
ccccucccgggagagccau

SEQ ID NO: 84 - RNA, 19 nt, Artificial Sequence
  Description of Artificial Sequence: Target Sequence/siNA sense region
ggagagccauaguggucug

SEQ ID NO: 85 - RNA, 19 nt, Artificial Sequence
  Description of Artificial Sequence: Target Sequence/siNA sense region
cccgggagagccauagugg

SEQ ID NO: 86 - RNA, 19 nt, Artificial Sequence
  Description of Artificial Sequence: Target Sequence/siNA sense region
cccccucccgggagagcca

SEQ ID NO: 87 - RNA, 19 nt, Artificial Sequence
  Description of Artificial Sequence: Target Sequence/siNA sense region
ucccgggagagccauagug

SEQ ID NO: 88 - RNA, 19 nt, Artificial Sequence
  Description of Artificial Sequence: Target Sequence/siNA sense region
ccccccucccgggagagcc

SEQ ID NO: 89 - RNA, 19 nt, Artificial Sequence
  Description of Artificial Sequence: Target Sequence/siNA sense region
cccucccgggagagccaua

SEQ ID NO: 90 - RNA, 19 nt, Artificial Sequence
  Description of Artificial Sequence: Target Sequence/siNA sense region
ccucccgggagagccauag

SEQ ID NO: 91 - RNA, 19 nt, Artificial Sequence
  Description of Artificial Sequence: Target Sequence/siNA sense region
cucccgggagagccauagu

SEQ ID NO: 92 - RNA, 19 nt, Artificial Sequence
  Description of Artificial Sequence: Target Sequence/siNA sense region
uguugccgcgcaggggccc

SEQ ID NO: 93 - RNA, 19 nt, Artificial Sequence
  Description of Artificial Sequence: Target Sequence/siNA sense region
cccccccucccgggagagc

SEQ ID NO: 94 - RNA, 19 nt, Artificial Sequence
  Description of Artificial Sequence: Target Sequence/siNA sense region
cauggcguuaguaugagug

SEQ ID NO: 95 - RNA, 19 nt, Artificial Sequence
  Description of Artificial Sequence: Target Sequence/siNA sense region
uagccauggcguuaguaug

SEQ ID NO: 96 - RNA, 19 nt, Artificial Sequence
  Description of Artificial Sequence: Target Sequence/siNA sense region
agccauggcguuaguauga

SEQ ID NO: 97 - RNA, 19 nt, Artificial Sequence
  Description of Artificial Sequence: Target Sequence/siNA sense region
ccauggcguuaguaugagu

SEQ ID NO: 98 - RNA, 19 nt, Artificial Sequence
  Description of Artificial Sequence: Target Sequence/siNA sense region
auggcguuaguaugagugu

SEQ ID NO: 99 - RNA, 19 nt, Artificial Sequence
  Description of Artificial Sequence: Target Sequence/siNA sense region
aagcgucuagccauggcgu

SEQ ID NO: 100 - RNA, 19 nt, Artificial Sequence
  Description of Artificial Sequence: Target Sequence/siNA sense region
gucuagccauggcguuagu

SEQ ID NO: 101 - RNA, 19 nt, Artificial Sequence
  Description of Artificial Sequence: Target Sequence/siNA sense region
aaagcgucuagccauggcg

SEQ ID NO: 102 - RNA, 19 nt, Artificial Sequence
  Description of Artificial Sequence: Target Sequence/siNA sense region
gcgucuagccauggcguua

SEQ ID NO: 103 - RNA, 19 nt, Artificial Sequence
  Description of Artificial Sequence: Target Sequence/siNA sense region
gccauggcguuaguaugag

SEQ ID NO: 104 - RNA, 19 nt, Artificial Sequence
  Description of Artificial Sequence: Target Sequence/siNA sense region
agcgucuagccauggcguu

SEQ ID NO: 105 - RNA, 19 nt, Artificial Sequence
  Description of Artificial Sequence: Target Sequence/siNA sense region
cgucuagccauggcguuag

SEQ ID NO: 106 - RNA, 19 nt, Artificial Sequence
  Description of Artificial Sequence: Target Sequence/siNA sense region
ucuagccauggcguuagua

SEQ ID NO: 107 - RNA, 19 nt, Artificial Sequence
  Description of Artificial Sequence: Target Sequence/siNA sense region
gaaagcgucuagccauggc

SEQ ID NO: 108 - RNA, 19 nt, Artificial Sequence
  Description of Artificial Sequence: Target Sequence/siNA sense region
cuagccauggcguuaguau

SEQ ID NO: 109 - RNA, 19 nt, Artificial Sequence
  Description of Artificial Sequence: Target Sequence/siNA sense region
cacuccccugugaggaacu

SEQ ID NO: 110 - RNA, 19 nt, Artificial Sequence
  Description of Artificial Sequence: Target Sequence/siNA sense region
accucaaagaaaaaccaaa

SEQ ID NO: 111 - RNA, 19 nt, Artificial Sequence
  Description of Artificial Sequence: Target Sequence/siNA sense region
cgcagaaagcgucuagcca

SEQ ID NO: 112 - RNA, 19 nt, Artificial Sequence
  Description of Artificial Sequence: Target Sequence/siNA sense region
ggguaaggucaucgauacc

SEQ ID NO: 113 - RNA, 19 nt, Artificial Sequence
  Description of Artificial Sequence: Target Sequence/siNA sense region
cagaaagcgucuagccaug

SEQ ID NO: 114 - RNA, 19 nt, Artificial Sequence
  Description of Artificial Sequence: Target Sequence/siNA sense region
aaaccucaaagaaaaacca

SEQ ID NO: 115 - RNA, 19 nt, Artificial Sequence
  Description of Artificial Sequence: Target Sequence/siNA sense region
gcagaaagcgucuagccau

SEQ ID NO: 116 - RNA, 19 nt, Artificial Sequence
  Description of Artificial Sequence: Target Sequence/siNA sense region
agaaagcgucuagccaugg

SEQ ID NO: 117 - RNA, 19 nt, Artificial Sequence
  Description of Artificial Sequence: Target Sequence/siNA sense region
acgcagaaagcgucuagcc

SEQ ID NO: 118 - RNA, 19 nt, Artificial Sequence
  Description of Artificial Sequence: Target Sequence/siNA sense region
aaccucaaagaaaaaccaa

SEQ ID NO: 119 - RNA, 19 nt, Artificial Sequence
  Description of Artificial Sequence: Target Sequence/siNA sense region
uggguaaggucaucgauac

SEQ ID NO: 120 - RNA, 19 nt, Artificial Sequence
  Description of Artificial Sequence: Target Sequence/siNA sense region
guaaggucaucgauacccu

SEQ ID NO: 121 - RNA, 19 nt, Artificial Sequence
  Description of Artificial Sequence: Target Sequence/siNA sense region
uucacgcagaaagcgucua

SEQ ID NO: 122 - RNA, 19 nt, Artificial Sequence
  Description of Artificial Sequence: Target Sequence/siNA sense region
gguaaggucaucgauaccc

SEQ ID NO: 123 - RNA, 19 nt, Artificial Sequence
  Description of Artificial Sequence: Target Sequence/siNA sense region
aucacuccccugugaggaa

SEQ ID NO: 124 - RNA, 19 nt, Artificial Sequence
  Description of Artificial Sequence: Target Sequence/siNA sense region
ucacuccccugugaggaac

SEQ ID NO: 125 - RNA, 19 nt, Artificial Sequence
  Description of Artificial Sequence: Target Sequence/siNA sense region
ugucuucacgcagaaagcg

SEQ ID NO: 126 - RNA, 19 nt, Artificial Sequence
  Description of Artificial Sequence: Target Sequence/siNA sense region
ucacgcagaaagcgucuag

SEQ ID NO: 127 - RNA, 19 nt, Artificial Sequence
  Description of Artificial Sequence: Target Sequence/siNA sense region
cacgcagaaagcgucuagc

SEQ ID NO: 128 - RNA, 19 nt, Artificial Sequence
  Description of Artificial Sequence: Target Sequence/siNA sense region
gaccggguccuuucuugga

SEQ ID NO: 129 - RNA, 19 nt, Artificial Sequence
  Description of Artificial Sequence: Target Sequence/siNA sense region
gaggaacuacugucuucac

SEQ ID NO: 130 - RNA, 19 nt, Artificial Sequence
  Description of Artificial Sequence: Target Sequence/siNA sense region
cugugaggaacuacugucu

SEQ ID NO: 131 - RNA, 19 nt, Artificial Sequence
  Description of Artificial Sequence: Target Sequence/siNA sense region
ggaacuacugucuucacgc

SEQ ID NO: 132 - RNA, 19 nt, Artificial Sequence
  Description of Artificial Sequence: Target Sequence/siNA sense region
acuccccugugaggaacua

SEQ ID NO: 133 - RNA, 19 nt, Artificial Sequence
  Description of Artificial Sequence: Target Sequence/siNA sense region
gucuucacgcagaaagcgu

SEQ ID NO: 134 - RNA, 19 nt, Artificial Sequence
  Description of Artificial Sequence: Target Sequence/siNA sense region
aggaacuacugucuucacg

SEQ ID NO: 135 - RNA, 19 nt, Artificial Sequence
  Description of Artificial Sequence: Target Sequence/siNA sense region
ccugugaggaacuacuguc

SEQ ID NO: 136 - RNA, 19 nt, Artificial Sequence
  Description of Artificial Sequence: Target Sequence/siNA sense region
ugugaggaacuacugucuu

SEQ ID NO: 137 - RNA, 19 nt, Artificial Sequence
  Description of Artificial Sequence: Target Sequence/siNA sense region
ucuucacgcagaaagcguc

SEQ ID NO: 138 - RNA, 19 nt, Artificial Sequence
  Description of Artificial Sequence: Target Sequence/siNA sense region
gaacuacugucuucacgca

SEQ ID NO: 139 - RNA, 19 nt, Artificial Sequence
  Description of Artificial Sequence: Target Sequence/siNA sense region
cccugugaggaacuacugu

SEQ ID NO: 140 - RNA, 19 nt, Artificial Sequence
  Description of Artificial Sequence: Target Sequence/siNA sense region
cuucacgcagaaagcgucu

SEQ ID NO: 141 - RNA, 19 nt, Artificial Sequence
  Description of Artificial Sequence: Target Sequence/siNA sense region
ugaggaacuacugucuuca

SEQ ID NO: 142 - RNA, 19 nt, Artificial Sequence
  Description of Artificial Sequence: Target Sequence/siNA sense region
uggcguuaguaugaguguc

SEQ ID NO: 143 - RNA, 19 nt, Artificial Sequence
  Description of Artificial Sequence: Target Sequence/siNA sense region
ccccugugaggaacuacug

SEQ ID NO: 144 - RNA, 19 nt, Artificial Sequence
  Description of Artificial Sequence: Target Sequence/siNA sense region
gugaggaacuacugucuuc

SEQ ID NO: 145 - RNA, 19 nt, Artificial Sequence
  Description of Artificial Sequence: Target Sequence/siNA sense region
ggcguuaguaugagugucg

SEQ ID NO: 146 - RNA, 19 nt, Artificial Sequence
  Description of Artificial Sequence: Target Sequence/siNA sense region
gccgaguaguguugggucg

SEQ ID NO: 147 - RNA, 19 nt, Artificial Sequence
  Description of Artificial Sequence: Target Sequence/siNA sense region
acugucuucacgcagaaag

SEQ ID NO: 148 - RNA, 19 nt, Artificial Sequence
  Description of Artificial Sequence: Target Sequence/siNA sense region
ugggucgcgaaaggccuug

SEQ ID NO: 149 - RNA, 19 nt, Artificial Sequence
  Description of Artificial Sequence: Target Sequence/siNA sense region
cuacugucuucacgcagaa

SEQ ID NO: 150 - RNA, 19 nt, Artificial Sequence
  Description of Artificial Sequence: Target Sequence/siNA sense region
cgaguaguguugggucgcg

SEQ ID NO: 151 - RNA, 19 nt, Artificial Sequence
  Description of Artificial Sequence: Target Sequence/siNA sense region
guaguguugggucgcgaaa

SEQ ID NO: 152 - RNA, 19 nt, Artificial Sequence
  Description of Artificial Sequence: Target Sequence/siNA sense region
uaaaccucaaagaaaaacc

SEQ ID NO: 153 - RNA, 19 nt, Artificial Sequence
  Description of Artificial Sequence: Target Sequence/siNA sense region
ccgaguaguguugggucgc

SEQ ID NO: 154 - RNA, 19 nt, Artificial Sequence
  Description of Artificial Sequence: Target Sequence/siNA sense region
agccgaguaguguuggguc

SEQ ID NO: 155 - RNA, 19 nt, Artificial Sequence
  Description of Artificial Sequence: Target Sequence/siNA sense region
gucgcgaaaggccuugugg

SEQ ID NO: 156 - RNA, 19 nt, Artificial Sequence
  Description of Artificial Sequence: Target Sequence/siNA sense region
uaguguugggucgcgaaag

SEQ ID NO: 157 - RNA, 19 nt, Artificial Sequence
  Description of Artificial Sequence: Target Sequence/siNA sense region
cuagccgaguaguguuggg

SEQ ID NO: 158 - RNA, 19 nt, Artificial Sequence
  Description of Artificial Sequence: Target Sequence/siNA sense region
gaguaguguugggucgcga

SEQ ID NO: 159 - RNA, 19 nt, Artificial Sequence
  Description of Artificial Sequence: Target Sequence/siNA sense region
ucgcgaaaggccuuguggu

SEQ ID NO: 160 - RNA, 19 nt, Artificial Sequence
  Description of Artificial Sequence: Target Sequence/siNA sense region
gcguuaguaugagugucgu

SEQ ID NO: 161 - RNA, 19 nt, Artificial Sequence
  Description of Artificial Sequence: Target Sequence/siNA sense region
uagccgaguaguguugggu

SEQ ID NO: 162 - RNA, 19 nt, Artificial Sequence
  Description of Artificial Sequence: Target Sequence/siNA sense region
aacuacugucuucacgcag

SEQ ID NO: 163 - RNA, 19 nt, Artificial Sequence
  Description of Artificial Sequence: Target Sequence/siNA sense region
cgcgaaaggccuuguggua

SEQ ID NO: 164 - RNA, 19 nt, Artificial Sequence
  Description of Artificial Sequence: Target Sequence/siNA sense region
aguguugggucgcgaaagg

SEQ ID NO: 165 - RNA, 19 nt, Artificial Sequence
  Description of Artificial Sequence: Target Sequence/siNA sense region
guugggucgcgaaaggccu

SEQ ID NO: 166 - RNA, 19 nt, Artificial Sequence
  Description of Artificial Sequence: Target Sequence/siNA sense region
aguaguguugggucgcgaa

SEQ ID NO: 167 - RNA, 19 nt, Artificial Sequence
  Description of Artificial Sequence: Target Sequence/siNA sense region
uugggucgcgaaaggccuu

SEQ ID NO: 168 - RNA, 19 nt, Artificial Sequence
  Description of Artificial Sequence: Target Sequence/siNA sense region
uccccugugaggaacuacu

SEQ ID NO: 169 - RNA, 19 nt, Artificial Sequence
  Description of Artificial Sequence: Target Sequence/siNA sense region
uacugucuucacgcagaaa

SEQ ID NO: 170 - RNA, 19 nt, Artificial Sequence
  Description of Artificial Sequence: Target Sequence/siNA sense region
guguugggucgcgaaaggc

SEQ ID NO: 171 - RNA, 19 nt, Artificial Sequence
  Description of Artificial Sequence: Target Sequence/siNA sense region
acuacugucuucacgcaga

SEQ ID NO: 172 - RNA, 19 nt, Artificial Sequence
  Description of Artificial Sequence: Target Sequence/siNA sense region
cugucuucacgcagaaagc

SEQ ID NO: 173 - RNA, 19 nt, Artificial Sequence
  Description of Artificial Sequence: Target Sequence/siNA sense region
gggucgcgaaaggccuugu

SEQ ID NO: 174 - RNA, 19 nt, Artificial Sequence
  Description of Artificial Sequence: Target Sequence/siNA sense region
ccuaaaccucaaagaaaaa

SEQ ID NO: 175 - RNA, 19 nt, Artificial Sequence
  Description of Artificial Sequence: Target Sequence/siNA sense region
ggucgcgaaaggccuugug

SEQ ID NO: 176 - RNA, 19 nt, Artificial Sequence
  Description of Artificial Sequence: Target Sequence/siNA sense region
cuaaaccucaaagaaaaac

SEQ ID NO: 177 - RNA, 19 nt, Artificial Sequence
  Description of Artificial Sequence: Target Sequence/siNA sense region
uguugggucgcgaaaggcc

SEQ ID NO: 178 - RNA, 19 nt, Artificial Sequence
  Description of Artificial Sequence: Target Sequence/siNA sense region
cuccccugugaggaacuac

SEQ ID NO: 179 - RNA, 19 nt, Artificial Sequence
  Description of Artificial Sequence: Target Sequence/siNA sense region
uccuaaaccucaaagaaaa

SEQ ID NO: 180 - RNA, 19 nt, Artificial Sequence
  Description of Artificial Sequence: Target Sequence/siNA sense region
accggguccuuucuuggau

SEQ ID NO: 181 - RNA, 19 nt, Artificial Sequence
  Description of Artificial Sequence: Target Sequence/siNA sense region
aauccuaaaccucaaagaa

SEQ ID NO: 182 - RNA, 19 nt, Artificial Sequence
  Description of Artificial Sequence: Target Sequence/siNA sense region
ucaaugccuggagauuugg

SEQ ID NO: 183 - RNA, 19 nt, Artificial Sequence
  Description of Artificial Sequence: Target Sequence/siNA sense region
augccuggagauuugggcg

SEQ ID NO: 184 - RNA, 19 nt, Artificial Sequence
  Description of Artificial Sequence: Target Sequence/siNA sense region
aaugccuggagauuugggc

SEQ ID NO: 185 - RNA, 19 nt, Artificial Sequence
  Description of Artificial Sequence: Target Sequence/siNA sense region
ccgaccucaugggguacau

SEQ ID NO: 186 - RNA, 19 nt, Artificial Sequence
  Description of Artificial Sequence: Target Sequence/siNA sense region
gcucaaugccuggagauuu

SEQ ID NO: 187 - RNA, 19 nt, Artificial Sequence
  Description of Artificial Sequence: Target Sequence/siNA sense region
cucaaugccuggagauuug

SEQ ID NO: 188 - RNA, 19 nt, Artificial Sequence
  Description of Artificial Sequence: Target Sequence/siNA sense region
gcuagccgaguaguguugg

SEQ ID NO: 189 - RNA, 19 nt, Artificial Sequence
  Description of Artificial Sequence: Target Sequence/siNA sense region
cgcucaaugccuggagauu

SEQ ID NO: 190 - RNA, 19 nt, Artificial Sequence
  Description of Artificial Sequence: Target Sequence/siNA sense region
caaugccuggagauuuggg

SEQ ID NO: 191 - RNA, 19 nt, Artificial Sequence
  Description of Artificial Sequence: Target Sequence/siNA sense region
gccgaccucaugggguaca

SEQ ID NO: 192 - RNA, 19 nt, Artificial Sequence
  Description of Artificial Sequence: Target Sequence/siNA sense region
auccuaaaccucaaagaaa

SEQ ID NO: 193 - RNA, 19 nt, Artificial Sequence
  Description of Artificial Sequence: Target Sequence/siNA sense region
agauuugggcgugcccccg

SEQ ID NO: 194 - RNA, 19 nt, Artificial Sequence
  Description of Artificial Sequence: Target Sequence/siNA sense region
cccgcucaaugccuggaga

SEQ ID NO: 195 - RNA, 19 nt, Artificial Sequence
  Description of Artificial Sequence: Target Sequence/siNA sense region
gagauuugggcgugccccc

SEQ ID NO: 196 - RNA, 19 nt, Artificial Sequence
  Description of Artificial Sequence: Target Sequence/siNA sense region
ggagauuugggcgugcccc

SEQ ID NO: 197 - RNA, 19 nt, Artificial Sequence
  Description of Artificial Sequence: Target Sequence/siNA sense region
gauuugggcgugcccccgc

SEQ ID NO: 198 - RNA, 19 nt, Artificial Sequence
  Description of Artificial Sequence: Target Sequence/siNA sense region
ccgcucaaugccuggagau

SEQ ID NO: 199 - RNA, 19 nt, Artificial Sequence
  Description of Artificial Sequence: Target Sequence/siNA sense region
aguacaccggaauugccag

SEQ ID NO: 200 - RNA, 19 nt, Artificial Sequence
  Description of Artificial Sequence: Target Sequence/siNA sense region
uacaccggaauugccagga

SEQ ID NO: 201 - RNA, 19 nt, Artificial Sequence
  Description of Artificial Sequence: Target Sequence/siNA sense region
gaguacaccggaauugcca

SEQ ID NO: 202 - RNA, 19 nt, Artificial Sequence
  Description of Artificial Sequence: Target Sequence/siNA sense region
guacaccggaauugccagg

SEQ ID NO: 203 - RNA, 19 nt, Artificial Sequence
  Description of Artificial Sequence: Target Sequence/siNA sense region
uugccgcgcaggggcccca

SEQ ID NO: 204 - RNA, 19 nt, Artificial Sequence
  Description of Artificial Sequence: Target Sequence/siNA sense region
cuggagauuugggcgugcc

SEQ ID NO: 205 - RNA, 19 nt, Artificial Sequence
  Description of Artificial Sequence: Target Sequence/siNA sense region
guugccgcgcaggggcccc

SEQ ID NO: 206 - RNA, 19 nt, Artificial Sequence
  Description of Artificial Sequence: Target Sequence/siNA sense region
gccuggagauuugggcgug

SEQ ID NO: 207 - RNA, 19 nt, Artificial Sequence
  Description of Artificial Sequence: Target Sequence/siNA sense region
uggagauuugggcgugccc

SEQ ID NO: 208 - RNA, 19 nt, Artificial Sequence
  Description of Artificial Sequence: Target Sequence/siNA sense region
ccuggagauuugggcgugc

SEQ ID NO: 209 - RNA, 19 nt, Artificial Sequence
  Description of Artificial Sequence: Target Sequence/siNA sense region
ugcuagccgaguaguguug

SEQ ID NO: 210 - RNA, 19 nt, Artificial Sequence
  Description of Artificial Sequence: Target Sequence/siNA sense region
ugccuggagauuugggcgu

SEQ ID NO: 211 - RNA, 19 nt, Artificial Sequence
  Description of Artificial Sequence: Target Sequence/siNA sense region
cugcuagccgaguaguguu

SEQ ID NO: 212 - RNA, 19 nt, Artificial Sequence
  Description of Artificial Sequence: Target Sequence/siNA sense region
acugcuagccgaguagugu

SEQ ID NO: 213 - RNA, 19 nt, Artificial Sequence
  Description of Artificial Sequence: Target Sequence/siNA sense region
gacugcuagccgaguagug

SEQ ID NO: 214 - RNA, 19 nt, Artificial Sequence
  Description of Artificial Sequence: Target Sequence/siNA sense region
agacugcuagccgaguagu

SEQ ID NO: 215 - RNA, 19 nt, Artificial Sequence
  Description of Artificial Sequence: Target Sequence/siNA sense region
acccgcucaaugccuggag

SEQ ID NO: 216 - RNA, 19 nt, Artificial Sequence
  Description of Artificial Sequence: Target Sequence/siNA sense region
aacccgcucaaugccugga

SEQ ID NO: 217 - RNA, 19 nt, Artificial Sequence
  Description of Artificial Sequence: Target Sequence/siNA sense region
ugccgcgcaggggccccag

SEQ ID NO: 218 - RNA, 19 nt, Artificial Sequence
  Description of Artificial Sequence: Target Sequence/siNA sense region
aggggccccagguugggug

SEQ ID NO: 219 - RNA, 19 nt, Artificial Sequence
  Description of Artificial Sequence: Target Sequence/siNA sense region
gggccccagguugggugug

SEQ ID NO: 220 - RNA, 19 nt, Artificial Sequence
  Description of Artificial Sequence: Target Sequence/siNA sense region
caggggccccagguugggu

SEQ ID NO: 221 - RNA, 19 nt, Artificial Sequence
  Description of Artificial Sequence: Target Sequence/siNA sense region
ggccccagguugggugugc

SEQ ID NO: 222 - RNA, 19 nt, Artificial Sequence
  Description of Artificial Sequence: Target Sequence/siNA sense region
cgcaggggccccagguugg

SEQ ID NO: 223 - RNA, 19 nt, Artificial Sequence
  Description of Artificial Sequence: Target Sequence/siNA sense region
ugggcaggauggcuccugu

SEQ ID NO: 224 - RNA, 19 nt, Artificial Sequence
  Description of Artificial Sequence: Target Sequence/siNA sense region
gccccagguugggugugcg

SEQ ID NO: 225 - RNA, 19 nt, Artificial Sequence
  Description of Artificial Sequence: Target Sequence/siNA sense region
gcaggggccccagguuggg

SEQ ID NO: 226 - RNA, 19 nt, Artificial Sequence
  Description of Artificial Sequence: Target Sequence/siNA sense region
gggcaggauggcuccuguc

SEQ ID NO: 227 - RNA, 19 nt, Artificial Sequence
  Description of Artificial Sequence: Target Sequence/siNA sense region
ggggccccagguugggugu

SEQ ID NO: 228 - RNA, 19 nt, Artificial Sequence
  Description of Artificial Sequence: Target Sequence/siNA sense region
gccgcgcaggggccccagg

SEQ ID NO: 229 - RNA, 19 nt, Artificial Sequence
  Description of Artificial Sequence: Target Sequence/siNA sense region
gcgcaggggccccagguug

SEQ ID NO: 230 - RNA, 19 nt, Artificial Sequence
  Description of Artificial Sequence: Target Sequence/siNA sense region
cgcgcaggggccccagguu

SEQ ID NO: 231 - RNA, 19 nt, Artificial Sequence
  Description of Artificial Sequence: Target Sequence/siNA sense region
ccgcgcaggggccccaggu

SEQ ID NO: 232 - RNA, 19 nt, Artificial Sequence
  Description of Artificial Sequence: Target Sequence/siNA sense region
aggacgaccggguccuuuc

SEQ ID NO: 233 - RNA, 19 nt, Artificial Sequence
  Description of Artificial Sequence: Target Sequence/siNA sense region
caggacgaccggguccuuu

SEQ ID NO: 234 - RNA, 19 nt, Artificial Sequence
  Description of Artificial Sequence: Target Sequence/siNA sense region
ugccaggacgaccgggucc

SEQ ID NO: 235 - RNA, 19 nt, Artificial Sequence
  Description of Artificial Sequence: Target Sequence/siNA sense region
auugccaggacgaccgggu

SEQ ID NO: 236 - RNA, 19 nt, Artificial Sequence
  Description of Artificial Sequence: Target Sequence/siNA sense region
aauugccaggacgaccggg

SEQ ID NO: 237 - RNA, 19 nt, Artificial Sequence
  Description of Artificial Sequence: Target Sequence/siNA sense region
uugccaggacgaccggguc

SEQ ID NO: 238 - RNA, 19 nt, Artificial Sequence
  Description of Artificial Sequence: Target Sequence/siNA sense region
ccaggacgaccggguccuu

SEQ ID NO: 239 - RNA, 19 nt, Artificial Sequence
  Description of Artificial Sequence: Target Sequence/siNA sense region
gccaggacgaccggguccu

SEQ ID NO: 240 - RNA, 19 nt, Artificial Sequence
  Description of Artificial Sequence: Target Sequence/siNA sense region
gaauugccaggacgaccgg

SEQ ID NO: 241 - RNA, 19 nt, Artificial Sequence
  Description of Artificial Sequence: Target Sequence/siNA sense region
acgaccggguccuuucuug

SEQ ID NO: 242 - RNA, 19 nt, Artificial Sequence
  Description of Artificial Sequence: Target Sequence/siNA sense region
gacgaccggguccuuucuu

SEQ ID NO: 243 - RNA, 19 nt, Artificial Sequence
  Description of Artificial Sequence: Target Sequence/siNA sense region
cgaccggguccuuucuugg

SEQ ID NO: 244 - RNA, 19 nt, Artificial Sequence
  Description of Artificial Sequence: Target Sequence/siNA sense region
ggacgaccggguccuuucu

SEQ ID NO: 245 - RNA, 19 nt, Artificial Sequence
  Description of Artificial Sequence: Target Sequence/siNA sense region
ccggaauugccaggacgac

SEQ ID NO: 246 - RNA, 19 nt, Artificial Sequence
  Description of Artificial Sequence: Target Sequence/siNA sense region
acaccggaauugccaggac

SEQ ID NO: 247 - RNA, 19 nt, Artificial Sequence
  Description of Artificial Sequence: Target Sequence/siNA sense region
accggaauugccaggacga

SEQ ID NO: 248 - RNA, 19 nt, Artificial Sequence
  Description of Artificial Sequence: Target Sequence/siNA sense region
cggaauugccaggacgacc

SEQ ID NO: 249 - RNA, 19 nt, Artificial Sequence
  Description of Artificial Sequence: Target Sequence/siNA sense region
ggaauugccaggacgaccg

SEQ ID NO: 250 - RNA, 19 nt, Artificial Sequence
  Description of Artificial Sequence: Target Sequence/siNA sense region
caccggaauugccaggacg

SEQ ID NO: 251 - RNA, 19 nt, Artificial Sequence
  Description of Artificial Sequence: Target Sequence/siNA sense region
ccccagguugggugugcgc

SEQ ID NO: 252 - RNA, 19 nt, Artificial Sequence
  Description of Artificial Sequence: Target Sequence/siNA sense region
gaucguugguggaguuuac

SEQ ID NO: 253 - RNA, 19 nt, Artificial Sequence
  Description of Artificial Sequence: Target Sequence/siNA sense region
cagaucguugguggaguuu

SEQ ID NO: 254 - RNA, 19 nt, Artificial Sequence
  Description of Artificial Sequence: Target Sequence/siNA sense region
agaucguugguggaguuua

SEQ ID NO: 255 - RNA, 19 nt, Artificial Sequence
  Description of Artificial Sequence: Target Sequence/siNA sense region
cccagguugggugugcgcg

SEQ ID NO: 256 - RNA, 19 nt, Artificial Sequence
  Description of Artificial Sequence: Target Sequence/siNA sense region
ccagguugggugugcgcgc

SEQ ID NO: 257 - RNA, 19 nt, Artificial Sequence
  Description of Artificial Sequence: Target Sequence/siNA sense region
agguugggugugcgcgcga

SEQ ID NO: 258 - RNA, 19 nt, Artificial Sequence
  Description of Artificial Sequence: Target Sequence/siNA sense region
cagguugggugugcgcgcg

SEQ ID NO: 259 - RNA, 19 nt, Artificial Sequence
  Description of Artificial Sequence: Target Sequence/siNA sense region
gguugggugugcgcgcgac

SEQ ID NO: 260 - RNA, 19 nt, Artificial Sequence
  Description of Artificial Sequence: Target Sequence/siNA sense region
gaaaaaccaaacguaacac

SEQ ID NO: 261 - RNA, 19 nt, Artificial Sequence
  Description of Artificial Sequence: Target Sequence/siNA sense region
agaaaaaccaaacguaaca

SEQ ID NO: 262 - RNA, 19 nt, Artificial Sequence
  Description of Artificial Sequence: Target Sequence/siNA sense region
aaccaaacguaacaccaac

SEQ ID NO: 263 - RNA, 19 nt, Artificial Sequence
  Description of Artificial Sequence: Target Sequence/siNA sense region
aaagaaaaaccaaacguaa

SEQ ID NO: 264 - RNA, 19 nt, Artificial Sequence
  Description of Artificial Sequence: Target Sequence/siNA sense region
aaaaaccaaacguaacacc

SEQ ID NO: 265 - RNA, 19 nt, Artificial Sequence
  Description of Artificial Sequence: Target Sequence/siNA sense region
aagaaaaaccaaacguaac

SEQ ID NO: 266 - RNA, 19 nt, Artificial Sequence
  Description of Artificial Sequence: Target Sequence/siNA sense region
caaagaaaaaccaaacgua

SEQ ID NO: 267 - RNA, 19 nt, Artificial Sequence
  Description of Artificial Sequence: Target Sequence/siNA sense region
acccccggcguaggucgcg

SEQ ID NO: 268 - RNA, 19 nt, Artificial Sequence
  Description of Artificial Sequence: Target Sequence/siNA sense region
gacccccggcguaggucgc

SEQ ID NO: 269 - RNA, 19 nt, Artificial Sequence
  Description of Artificial Sequence: Target Sequence/siNA sense region
cguuaguaugagugucgug

SEQ ID NO: 270 - RNA, 19 nt, Artificial Sequence
  Description of Artificial Sequence: Target Sequence/siNA sense region
guuaguaugagugucgugc

SEQ ID NO: 271 - RNA, 19 nt, Artificial Sequence
  Description of Artificial Sequence: Target Sequence/siNA sense region
uuaguaugagugucgugca

SEQ ID NO: 272 - RNA, 19 nt, Artificial Sequence
  Description of Artificial Sequence: Target Sequence/siNA sense region
ccaaacguaacaccaaccg

SEQ ID NO: 273 - RNA, 19 nt, Artificial Sequence
  Description of Artificial Sequence: Target Sequence/siNA sense region
accaaacguaacaccaacc

SEQ ID NO: 274 - RNA, 19 nt, Artificial Sequence
  Description of Artificial Sequence: Target Sequence/siNA sense region
uugggcgugcccccgcgag

SEQ ID NO: 275 - RNA, 19 nt, Artificial Sequence
  Description of Artificial Sequence: Target Sequence/siNA sense region
auuugggcgugcccccgcg

SEQ ID NO: 276 - RNA, 19 nt, Artificial Sequence
  Description of Artificial Sequence: Target Sequence/siNA sense region
uuugggcgugcccccgcga

SEQ ID NO: 277 - RNA, 19 nt, Artificial Sequence
  Description of Artificial Sequence: Target Sequence/siNA sense region
aaaccaaacguaacaccaa

SEQ ID NO: 278 - RNA, 19 nt, Artificial Sequence
  Description of Artificial Sequence: Target Sequence/siNA sense region
ugggcgugcccccgcgaga

SEQ ID NO: 279 - RNA, 19 nt, Artificial Sequence
  Description of Artificial Sequence: Target Sequence/siNA sense region
gucagaucguugguggagu

SEQ ID NO: 280 - RNA, 19 nt, Artificial Sequence
  Description of Artificial Sequence: Target Sequence/siNA sense region
gugucgugcagccuccagg

SEQ ID NO: 281 - RNA, 19 nt, Artificial Sequence
  Description of Artificial Sequence: Target Sequence/siNA sense region
ggucagaucguugguggag

SEQ ID NO: 282 - RNA, 19 nt, Artificial Sequence
  Description of Artificial Sequence: Target Sequence/siNA sense region
agugucgugcagccuccag

SEQ ID NO: 283 - RNA, 19 nt, Artificial Sequence
  Description of Artificial Sequence: Target Sequence/siNA sense region
gagugucgugcagccucca

SEQ ID NO: 284 - RNA, 19 nt, Artificial Sequence
  Description of Artificial Sequence: Target Sequence/siNA sense region
ucguagaccgugcaccaug

SEQ ID NO: 285 - RNA, 19 nt, Artificial Sequence
  Description of Artificial Sequence: Target Sequence/siNA sense region
gaccgugcaccaugagcac

SEQ ID NO: 286 - RNA, 19 nt, Artificial Sequence
  Description of Artificial Sequence: Target Sequence/siNA sense region
aguaugagugucgugcagc

SEQ ID NO: 287 - RNA, 19 nt, Artificial Sequence
  Description of Artificial Sequence: Target Sequence/siNA sense region
uaguaugagugucgugcag

SEQ ID NO: 288 - RNA, 19 nt, Artificial Sequence
  Description of Artificial Sequence: Target Sequence/siNA sense region
ucagaucguugguggaguu

SEQ ID NO: 289 - RNA, 19 nt, Artificial Sequence
  Description of Artificial Sequence: Target Sequence/siNA sense region
agaccgugcaccaugagca

SEQ ID NO: 290 - RNA, 19 nt, Artificial Sequence
  Description of Artificial Sequence: Target Sequence/siNA sense region
aaaaccaaacguaacacca

SEQ ID NO: 291 - RNA, 19 nt, Artificial Sequence
  Description of Artificial Sequence: Target Sequence/siNA sense region
guagaccgugcaccaugag

SEQ ID NO: 292 - RNA, 19 nt, Artificial Sequence
  Description of Artificial Sequence: Target Sequence/siNA sense region
cucguagaccgugcaccau

SEQ ID NO: 293 - RNA, 19 nt, Artificial Sequence
  Description of Artificial Sequence: Target Sequence/siNA sense region
cguagaccgugcaccauga

SEQ ID NO: 294 - RNA, 19 nt, Artificial Sequence
  Description of Artificial Sequence: Target Sequence/siNA sense region
ccugggcucagcccgggua

SEQ ID NO: 295 - RNA, 19 nt, Artificial Sequence
  Description of Artificial Sequence: Target Sequence/siNA sense region
uagaccgugcaccaugagc

SEQ ID NO: 296 - RNA, 19 nt, Artificial Sequence
  Description of Artificial Sequence: Target Sequence/siNA sense region
ggucucguagaccgugcac

SEQ ID NO: 297 - RNA, 19 nt, Artificial Sequence
  Description of Artificial Sequence: Target Sequence/siNA sense region
ucucguagaccgugcacca

SEQ ID NO: 298 - RNA, 19 nt, Artificial Sequence
  Description of Artificial Sequence: Target Sequence/siNA sense region
gucucguagaccgugcacc

SEQ ID NO: 299 - RNA, 19 nt, Artificial Sequence
  Description of Artificial Sequence: Target Sequence/siNA sense region
uuggguaaggucaucgaua

SEQ ID NO: 300 - RNA, 19 nt, Artificial Sequence
  Description of Artificial Sequence: Target Sequence/siNA sense region
ucgccgaccucauggggua

SEQ ID NO: 301 - RNA, 19 nt, Artificial Sequence
  Description of Artificial Sequence: Target Sequence/siNA sense region
ccucaaagaaaaaccaaac

SEQ ID NO: 302 - RNA, 19 nt, Artificial Sequence
  Description of Artificial Sequence: Target Sequence/siNA sense region
gggcgugcccccgcgagac

SEQ ID NO: 303 - RNA, 19 nt, Artificial Sequence
  Description of Artificial Sequence: Target Sequence/siNA sense region
ggaugaaccggcugauagc

SEQ ID NO: 304 - RNA, 19 nt, Artificial Sequence
  Description of Artificial Sequence: Target Sequence/siNA sense region
uggaugaaccggcugauag

SEQ ID NO: 305 - RNA, 19 nt, Artificial Sequence
  Description of Artificial Sequence: Target Sequence/siNA sense region
cucaaagaaaaaccaaacg

SEQ ID NO: 306 - RNA, 19 nt, Artificial Sequence
  Description of Artificial Sequence: Target Sequence/siNA sense region
aggaagacuuccgagcggu

SEQ ID NO: 307 - RNA, 19 nt, Artificial Sequence
  Description of Artificial Sequence: Target Sequence/siNA sense region
ucaaagaaaaaccaaacgu

SEQ ID NO: 308 - RNA, 19 nt, Artificial Sequence
  Description of Artificial Sequence: Target Sequence/siNA sense region
ggaagacuuccgagcgguc

SEQ ID NO: 309 - RNA, 19 nt, Artificial Sequence
  Description of Artificial Sequence: Target Sequence/siNA sense region
cgccgaccucaugggguac

SEQ ID NO: 310 - RNA, 19 nt, Artificial Sequence
  Description of Artificial Sequence: Target Sequence/siNA sense region
cuuccgagcggucgcaacc

SEQ ID NO: 311 - RNA, 19 nt, Artificial Sequence
  Description of Artificial Sequence: Target Sequence/siNA sense region
ggcgugcccccgcgagacu

SEQ ID NO: 312 - RNA, 19 nt, Artificial Sequence
  Description of Artificial Sequence: Target Sequence/siNA sense region
uaugagugucgugcagccu

SEQ ID NO: 313 - RNA, 19 nt, Artificial Sequence
  Description of Artificial Sequence: Target Sequence/siNA sense region
ugcccccgcgagacugcua

SEQ ID NO: 314 - RNA, 19 nt, Artificial Sequence
  Description of Artificial Sequence: Target Sequence/siNA sense region
cgagacugcuagccgagua

SEQ ID NO: 315 - RNA, 19 nt, Artificial Sequence
  Description of Artificial Sequence: Target Sequence/siNA sense region
ugagugucgugcagccucc

SEQ ID NO: 316 - RNA, 19 nt, Artificial Sequence
  Description of Artificial Sequence: Target Sequence/siNA sense region
gcccccgcgagacugcuag

SEQ ID NO: 317 - RNA, 19 nt, Artificial Sequence
  Description of Artificial Sequence: Target Sequence/siNA sense region
gagacugcuagccgaguag

SEQ ID NO: 318 - RNA, 19 nt, Artificial Sequence
  Description of Artificial Sequence: Target Sequence/siNA sense region
cccccgcgagacugcuagc

SEQ ID NO: 319 - RNA, 19 nt, Artificial Sequence
  Description of Artificial Sequence: Target Sequence/siNA sense region
cgcgagacugcuagccgag

SEQ ID NO: 320 - RNA, 19 nt, Artificial Sequence
  Description of Artificial Sequence: Target Sequence/siNA sense region
guaugagugucgugcagcc

SEQ ID NO: 321 - RNA, 19 nt, Artificial Sequence
  Description of Artificial Sequence: Target Sequence/siNA sense region
augagugucgugcagccuc

SEQ ID NO: 322 - RNA, 19 nt, Artificial Sequence
  Description of Artificial Sequence: Target Sequence/siNA sense region
gcgagacugcuagccgagu

SEQ ID NO: 323 - RNA, 19 nt, Artificial Sequence
  Description of Artificial Sequence: Target Sequence/siNA sense region
ccccgcgagacugcuagcc

SEQ ID NO: 324 - RNA, 19 nt, Artificial Sequence
  Description of Artificial Sequence: Target Sequence/siNA sense region
ccgcgagacugcuagccga

SEQ ID NO: 325 - RNA, 19 nt, Artificial Sequence
  Description of Artificial Sequence: Target Sequence/siNA sense region
cccgcgagacugcuagccg

SEQ ID NO: 326 - RNA, 19 nt, Artificial Sequence
  Description of Artificial Sequence: Target Sequence/siNA sense region
gcgugcccccgcgagacug

SEQ ID NO: 327 - RNA, 19 nt, Artificial Sequence
  Description of Artificial Sequence: Target Sequence/siNA sense region
gacccccccucccgggaga

SEQ ID NO: 328 - RNA, 19 nt, Artificial Sequence
  Description of Artificial Sequence: Target Sequence/siNA sense region
cggguccuuucuuggauca

SEQ ID NO: 329 - RNA, 19 nt, Artificial Sequence
  Description of Artificial Sequence: Target Sequence/siNA sense region
gugcccccgcgagacugcu

SEQ ID NO: 330 - RNA, 19 nt, Artificial Sequence
  Description of Artificial Sequence: Target Sequence/siNA sense region
cgugcccccgcgagacugc

SEQ ID NO: 331 - RNA, 19 nt, Artificial Sequence
  Description of Artificial Sequence: Target Sequence/siNA sense region
uucgccgaccucauggggu

SEQ ID NO: 332 - RNA, 19 nt, Artificial Sequence
  Description of Artificial Sequence: Target Sequence/siNA sense region
cgcccacaggacgucaagu

SEQ ID NO: 333 - RNA, 19 nt, Artificial Sequence
  Description of Artificial Sequence: Target Sequence/siNA sense region
gcccacaggacgucaaguu

SEQ ID NO: 334 - RNA, 19 nt, Artificial Sequence
  Description of Artificial Sequence: Target Sequence/siNA sense region
acccccccucccgggagag

SEQ ID NO: 335 - RNA, 19 nt, Artificial Sequence
  Description of Artificial Sequence: Target Sequence/siNA sense region
ggacccccccucccgggag

SEQ ID NO: 336 - RNA, 19 nt, Artificial Sequence
  Description of Artificial Sequence: Target Sequence/siNA sense region
ccggguccuuucuuggauc

SEQ ID NO: 337 - RNA, 19 nt, Artificial Sequence
  Description of Artificial Sequence: Target Sequence/siNA sense region
caggacccccccucccggg

SEQ ID NO: 338 - RNA, 19 nt, Artificial Sequence
  Description of Artificial Sequence: Target Sequence/siNA sense region
aggacgucaaguucccggg

SEQ ID NO: 339 - RNA, 19 nt, Artificial Sequence
  Description of Artificial Sequence: Target Sequence/siNA sense region
aggacccccccucccggga

SEQ ID NO: 340 - RNA, 19 nt, Artificial Sequence
  Description of Artificial Sequence: Target Sequence/siNA sense region
ccacaggacgucaaguucc

SEQ ID NO: 341 - RNA, 19 nt, Artificial Sequence
  Description of Artificial Sequence: Target Sequence/siNA sense region
caggacgucaaguucccgg

SEQ ID NO: 342 - RNA, 19 nt, Artificial Sequence
  Description of Artificial Sequence: Target Sequence/siNA sense region
acaggacgucaaguucccg

SEQ ID NO: 343 - RNA, 19 nt, Artificial Sequence
  Description of Artificial Sequence: Target Sequence/siNA sense region
cacaggacgucaaguuccc

SEQ ID NO: 344 - RNA, 19 nt, Artificial Sequence
  Description of Artificial Sequence: Target Sequence/siNA sense region
caguggaugaaccggcuga

SEQ ID NO: 345 - RNA, 19 nt, Artificial Sequence
  Description of Artificial Sequence: Target Sequence/siNA sense region
gggcucagcccggguaccc

SEQ ID NO: 346 - RNA, 19 nt, Artificial Sequence
  Description of Artificial Sequence: Target Sequence/siNA sense region
ccgagcggucgcaaccucg

SEQ ID NO: 347 - RNA, 19 nt, Artificial Sequence
  Description of Artificial Sequence: Target Sequence/siNA sense region
cugggcucagcccggguac

SEQ ID NO: 348 - RNA, 19 nt, Artificial Sequence
  Description of Artificial Sequence: Target Sequence/siNA sense region
aguggaugaaccggcugau

SEQ ID NO: 349 - RNA, 19 nt, Artificial Sequence
  Description of Artificial Sequence: Target Sequence/siNA sense region
uccgagcggucgcaaccuc

SEQ ID NO: 350 - RNA, 19 nt, Artificial Sequence
  Description of Artificial Sequence: Target Sequence/siNA sense region
ugggcucagcccggguacc

SEQ ID NO: 351 - RNA, 19 nt, Artificial Sequence
  Description of Artificial Sequence: Target Sequence/siNA sense region
gguacccuuggccccucua

SEQ ID NO: 352 - RNA, 19 nt, Artificial Sequence
  Description of Artificial Sequence: Target Sequence/siNA sense region
uuccgagcggucgcaaccu

SEQ ID NO: 353 - RNA, 19 nt, Artificial Sequence
  Description of Artificial Sequence: Target Sequence/siNA sense region
ggguacccuuggccccucu

SEQ ID NO: 354 - RNA, 19 nt, Artificial Sequence
  Description of Artificial Sequence: Target Sequence/siNA sense region
ggguccuuucuuggaucaa

SEQ ID NO: 355 - RNA, 19 nt, Artificial Sequence
  Description of Artificial Sequence: Target Sequence/siNA sense region
cccacaggacgucaaguuc

SEQ ID NO: 356 - RNA, 19 nt, Artificial Sequence
  Description of Artificial Sequence: Target Sequence/siNA sense region
gguugcucuuucucuaucu

SEQ ID NO: 357 - RNA, 19 nt, Artificial Sequence
  Description of Artificial Sequence: Target Sequence/siNA sense region
gugggcaggauggcuccug

SEQ ID NO: 358 - RNA, 19 nt, Artificial Sequence
  Description of Artificial Sequence: Target Sequence/siNA sense region
ggugggcaggauggcuccu

SEQ ID NO: 359 - RNA, 19 nt, Artificial Sequence
  Description of Artificial Sequence: Target Sequence/siNA sense region
guugcucuuucucuaucuu

SEQ ID NO: 360 - RNA, 19 nt, Artificial Sequence
  Description of Artificial Sequence: Target Sequence/siNA sense region
guggaugaaccggcugaua

SEQ ID NO: 361 - RNA, 19 nt, Artificial Sequence
  Description of Artificial Sequence: Target Sequence/siNA sense region
ccaggacccccccucccgg

SEQ ID NO: 362 - RNA, 19 nt, Artificial Sequence
  Description of Artificial Sequence: Target Sequence/siNA sense region
gggugggcaggauggcucc

SEQ ID NO: 363 - RNA, 19 nt, Artificial Sequence
  Description of Artificial Sequence: Target Sequence/siNA sense region
cuucacggaggcuaugacu

SEQ ID NO: 364 - RNA, 19 nt, Artificial Sequence
  Description of Artificial Sequence: Target Sequence/siNA sense region
accgccgcccacaggacgu

SEQ ID NO: 365 - RNA, 19 nt, Artificial Sequence
  Description of Artificial Sequence: Target Sequence/siNA sense region
uccaggacccccccucccg

SEQ ID NO: 366 - RNA, 19 nt, Artificial Sequence
  Description of Artificial Sequence: Target Sequence/siNA sense region
auaugaugaugaacugguc

SEQ ID NO: 367 - RNA, 19 nt, Artificial Sequence
  Description of Artificial Sequence: Target Sequence/siNA sense region
uucacggaggcuaugacua

SEQ ID NO: 368 - RNA, 19 nt, Artificial Sequence
  Description of Artificial Sequence: Target Sequence/siNA sense region
ucacggaggcuaugacuag

SEQ ID NO: 369 - RNA, 19 nt, Artificial Sequence
  Description of Artificial Sequence: Target Sequence/siNA sense region
augaaccggcugauagcgu

SEQ ID NO: 370 - RNA, 19 nt, Artificial Sequence
  Description of Artificial Sequence: Target Sequence/siNA sense region
gggauaugaugaugaacug

SEQ ID NO: 371 - RNA, 19 nt, Artificial Sequence
  Description of Artificial Sequence: Target Sequence/siNA sense region
ugcaguggaugaaccggcu

SEQ ID NO: 372 - RNA, 19 nt, Artificial Sequence
  Description of Artificial Sequence: Target Sequence/siNA sense region
gugcaguggaugaaccggc

SEQ ID NO: 373 - RNA, 19 nt, Artificial Sequence
  Description of Artificial Sequence: Target Sequence/siNA sense region
ugaaccggcugauagcguu

SEQ ID NO: 374 - RNA, 19 nt, Artificial Sequence
  Description of Artificial Sequence: Target Sequence/siNA sense region
ggauaugaugaugaacugg

SEQ ID NO: 375 - RNA, 19 nt, Artificial Sequence
  Description of Artificial Sequence: Target Sequence/siNA sense region
gcucuuucucuaucuuccu

SEQ ID NO: 376 - RNA, 19 nt, Artificial Sequence
  Description of Artificial Sequence: Target Sequence/siNA sense region
gggggcgacacuccaccau

SEQ ID NO: 377 - RNA, 19 nt, Artificial Sequence
  Description of Artificial Sequence: Target Sequence/siNA sense region
gaugaaccggcugauagcg

SEQ ID NO: 378 - RNA, 19 nt, Artificial Sequence
  Description of Artificial Sequence: Target Sequence/siNA sense region
gauaugaugaugaacuggu

SEQ ID NO: 379 - RNA, 19 nt, Artificial Sequence
  Description of Artificial Sequence: Target Sequence/siNA sense region
ugggauaugaugaugaacu

SEQ ID NO: 380 - RNA, 19 nt, Artificial Sequence
  Description of Artificial Sequence: Target Sequence/siNA sense region
uugcucuuucucuaucuuc

SEQ ID NO: 381 - RNA, 19 nt, Artificial Sequence
  Description of Artificial Sequence: Target Sequence/siNA sense region
ugggggcgacacuccacca

SEQ ID NO: 382 - RNA, 19 nt, Artificial Sequence
  Description of Artificial Sequence: Target Sequence/siNA sense region
ugcucuuucucuaucuucc

SEQ ID NO: 383 - RNA, 19 nt, Artificial Sequence
  Description of Artificial Sequence: Target Sequence/siNA sense region
gguccuuucuuggaucaac

SEQ ID NO: 384 - RNA, 19 nt, Artificial Sequence
  Description of Artificial Sequence: Target Sequence/siNA sense region
aagacuuccgagcggucgc

SEQ ID NO: 385 - RNA, 19 nt, Artificial Sequence
  Description of Artificial Sequence: Target Sequence/siNA sense region
agcccggguacccuuggcc

SEQ ID NO: 386 - RNA, 19 nt, Artificial Sequence
  Description of Artificial Sequence: Target Sequence/siNA sense region
uuucuuggaucaacccgcu

SEQ ID NO: 387 - RNA, 19 nt, Artificial Sequence
  Description of Artificial Sequence: Target Sequence/siNA sense region
cagcccggguacccuuggc

SEQ ID NO: 388 - RNA, 19 nt, Artificial Sequence
  Description of Artificial Sequence: Target Sequence/siNA sense region
agacuuccgagcggucgca

SEQ ID NO: 389 - RNA, 19 nt, Artificial Sequence
  Description of Artificial Sequence: Target Sequence/siNA sense region
uucuuggaucaacccgcuc

SEQ ID NO: 390 - RNA, 19 nt, Artificial Sequence
  Description of Artificial Sequence: Target Sequence/siNA sense region
cccggguacccuuggcccc

SEQ ID NO: 391 - RNA, 19 nt, Artificial Sequence
  Description of Artificial Sequence: Target Sequence/siNA sense region
guccuuucuuggaucaacc

SEQ ID NO: 392 - RNA, 19 nt, Artificial Sequence
  Description of Artificial Sequence: Target Sequence/siNA sense region
cuuucuuggaucaacccgc

SEQ ID NO: 393 - RNA, 19 nt, Artificial Sequence
  Description of Artificial Sequence: Target Sequence/siNA sense region
ccuuucuuggaucaacccg

SEQ ID NO: 394 - RNA, 19 nt, Artificial Sequence
  Description of Artificial Sequence: Target Sequence/siNA sense region
uccuuucuuggaucaaccc

SEQ ID NO: 395 - RNA, 19 nt, Artificial Sequence
  Description of Artificial Sequence: Target Sequence/siNA sense region
aaguucccgggcggugguc

SEQ ID NO: 396 - RNA, 19 nt, Artificial Sequence
  Description of Artificial Sequence: Target Sequence/siNA sense region
gcaguggaugaaccggcug

SEQ ID NO: 397 - RNA, 19 nt, Artificial Sequence
  Description of Artificial Sequence: Target Sequence/siNA sense region
ccggguacccuuggccccu

SEQ ID NO: 398 - RNA, 19 nt, Artificial Sequence
  Description of Artificial Sequence: Target Sequence/siNA sense region
aguucccgggcggugguca

SEQ ID NO: 399 - RNA, 19 nt, Artificial Sequence
  Description of Artificial Sequence: Target Sequence/siNA sense region
cuuggaucaacccgcucaa

SEQ ID NO: 400 - RNA, 19 nt, Artificial Sequence
  Description of Artificial Sequence: Target Sequence/siNA sense region
ggaucaacccgcucaaugc

SEQ ID NO: 401 - RNA, 19 nt, Artificial Sequence
  Description of Artificial Sequence: Target Sequence/siNA sense region
acuuccgagcggucgcaac

SEQ ID NO: 402 - RNA, 19 nt, Artificial Sequence
  Description of Artificial Sequence: Target Sequence/siNA sense region
ucuuggaucaacccgcuca

SEQ ID NO: 403 - RNA, 19 nt, Artificial Sequence
  Description of Artificial Sequence: Target Sequence/siNA sense region
uuggaucaacccgcucaau

SEQ ID NO: 404 - RNA, 19 nt, Artificial Sequence
  Description of Artificial Sequence: Target Sequence/siNA sense region
aaccgccgcccacaggacg

SEQ ID NO: 405 - RNA, 19 nt, Artificial Sequence
  Description of Artificial Sequence: Target Sequence/siNA sense region
gcgugaacuaugcaacagg

SEQ ID NO: 406 - RNA, 19 nt, Artificial Sequence
  Description of Artificial Sequence: Target Sequence/siNA sense region
aucaacccgcucaaugccu

SEQ ID NO: 407 - RNA, 19 nt, Artificial Sequence
  Description of Artificial Sequence: Target Sequence/siNA sense region
gaucaacccgcucaaugcc

SEQ ID NO: 408 - RNA, 19 nt, Artificial Sequence
  Description of Artificial Sequence: Target Sequence/siNA sense region
caacccgcucaaugccugg

SEQ ID NO: 409 - RNA, 19 nt, Artificial Sequence
  Description of Artificial Sequence: Target Sequence/siNA sense region
gcuucgccgaccucauggg

SEQ ID NO: 410 - RNA, 19 nt, Artificial Sequence
  Description of Artificial Sequence: Target Sequence/siNA sense region
gacuuccgagcggucgcaa

SEQ ID NO: 411 - RNA, 19 nt, Artificial Sequence
  Description of Artificial Sequence: Target Sequence/siNA sense region
ucaacccgcucaaugccug

SEQ ID NO: 412 - RNA, 19 nt, Artificial Sequence
  Description of Artificial Sequence: Target Sequence/siNA sense region
ggcuucgccgaccucaugg

SEQ ID NO: 413 - RNA, 19 nt, Artificial Sequence
  Description of Artificial Sequence: Target Sequence/siNA sense region
uggaucaacccgcucaaug

SEQ ID NO: 414 - RNA, 19 nt, Artificial Sequence
  Description of Artificial Sequence: Target Sequence/siNA sense region
cgggcgguggucagaucgu

SEQ ID NO: 415 - RNA, 19 nt, Artificial Sequence
  Description of Artificial Sequence: Target Sequence/siNA sense region
cuuggccccucuauggcaa

SEQ ID NO: 416 - RNA, 19 nt, Artificial Sequence
  Description of Artificial Sequence: Target Sequence/siNA sense region
ccgggcgguggucagaucg

SEQ ID NO: 417 - RNA, 19 nt, Artificial Sequence
  Description of Artificial Sequence: Target Sequence/siNA sense region
uggggugggcaggauggcu

SEQ ID NO: 418 - RNA, 19 nt, Artificial Sequence
  Description of Artificial Sequence: Target Sequence/siNA sense region
ggaguuuaccuguugccgc

SEQ ID NO: 419 - RNA, 19 nt, Artificial Sequence
  Description of Artificial Sequence: Target Sequence/siNA sense region
ccuuggccccucuauggca

SEQ ID NO: 420 - RNA, 19 nt, Artificial Sequence
  Description of Artificial Sequence: Target Sequence/siNA sense region
guggaguuuaccuguugcc

SEQ ID NO: 421 - RNA, 19 nt, Artificial Sequence
  Description of Artificial Sequence: Target Sequence/siNA sense region
gguggaguuuaccuguugc

SEQ ID NO: 422 - RNA, 19 nt, Artificial Sequence
  Description of Artificial Sequence: Target Sequence/siNA sense region
uucccgggcgguggucaga

SEQ ID NO: 423 - RNA, 19 nt, Artificial Sequence
  Description of Artificial Sequence: Target Sequence/siNA sense region
ugaacuaugcaacagggaa

SEQ ID NO: 424 - RNA, 19 nt, Artificial Sequence
  Description of Artificial Sequence: Target Sequence/siNA sense region
aguuuaccuguugccgcgc

SEQ ID NO: 425 - RNA, 19 nt, Artificial Sequence
  Description of Artificial Sequence: Target Sequence/siNA sense region
gugaacuaugcaacaggga

SEQ ID NO: 426 - RNA, 19 nt, Artificial Sequence
  Description of Artificial Sequence: Target Sequence/siNA sense region
uuaccuguugccgcgcagg

SEQ ID NO: 427 - RNA, 19 nt, Artificial Sequence
  Description of Artificial Sequence: Target Sequence/siNA sense region
ucccgggcgguggucagau

SEQ ID NO: 428 - RNA, 19 nt, Artificial Sequence
  Description of Artificial Sequence: Target Sequence/siNA sense region
guucccgggcgguggucag

SEQ ID NO: 429 - RNA, 19 nt, Artificial Sequence
  Description of Artificial Sequence: Target Sequence/siNA sense region
gcccggguacccuuggccc

SEQ ID NO: 430 - RNA, 19 nt, Artificial Sequence
  Description of Artificial Sequence: Target Sequence/siNA sense region
aaggagaugaaggcgaagg

SEQ ID NO: 431 - RNA, 19 nt, Artificial Sequence
  Description of Artificial Sequence: Target Sequence/siNA sense region
aggagaugaaggcgaaggc

SEQ ID NO: 432 - RNA, 19 nt, Artificial Sequence
  Description of Artificial Sequence: Target Sequence/siNA sense region
guuuaccuguugccgcgca

SEQ ID NO: 433 - RNA, 19 nt, Artificial Sequence
  Description of Artificial Sequence: Target Sequence/siNA sense region
cuguugccgcgcaggggcc

SEQ ID NO: 434 - RNA, 19 nt, Artificial Sequence
  Description of Artificial Sequence: Target Sequence/siNA sense region
aacaccaaccgccgcccac

SEQ ID NO: 435 - RNA, 19 nt, Artificial Sequence
  Description of Artificial Sequence: Target Sequence/siNA sense region
gaguuuaccuguugccgcg

SEQ ID NO: 436 - RNA, 19 nt, Artificial Sequence
  Description of Artificial Sequence: Target Sequence/siNA sense region
uuuaccuguugccgcgcag

SEQ ID NO: 437 - RNA, 19 nt, Artificial Sequence
  Description of Artificial Sequence: Target Sequence/siNA sense region
ggggugggcaggauggcuc

SEQ ID NO: 438 - RNA, 19 nt, Artificial Sequence
  Description of Artificial Sequence: Target Sequence/siNA sense region
gaagacuuccgagcggucg

SEQ ID NO: 439 - RNA, 19 nt, Artificial Sequence
  Description of Artificial Sequence: Target Sequence/siNA sense region
accuguugccgcgcagggg

SEQ ID NO: 440 - RNA, 19 nt, Artificial Sequence
  Description of Artificial Sequence: Target Sequence/siNA sense region
uaccuguugccgcgcaggg

SEQ ID NO: 441 - RNA, 19 nt, Artificial Sequence
  Description of Artificial Sequence: Target Sequence/siNA sense region
uaccucuucaacugggcag

SEQ ID NO: 442 - RNA, 19 nt, Artificial Sequence
  Description of Artificial Sequence: Target Sequence/siNA sense region
cgugaacuaugcaacaggg

SEQ ID NO: 443 - RNA, 19 nt, Artificial Sequence
  Description of Artificial Sequence: Target Sequence/siNA sense region
acaccaaccgccgcccaca

SEQ ID NO: 444 - RNA, 19 nt, Artificial Sequence
  Description of Artificial Sequence: Target Sequence/siNA sense region
cccgggcgguggucagauc

SEQ ID NO: 445 - RNA, 19 nt, Artificial Sequence
  Description of Artificial Sequence: Target Sequence/siNA sense region
accucuucaacugggcagu

SEQ ID NO: 446 - RNA, 19 nt, Artificial Sequence
  Description of Artificial Sequence: Target Sequence/siNA sense region
cuucgccgaccucaugggg

SEQ ID NO: 447 - RNA, 19 nt, Artificial Sequence
  Description of Artificial Sequence: Target Sequence/siNA sense region
ccuguugccgcgcaggggc

SEQ ID NO: 448 - RNA, 19 nt, Artificial Sequence
  Description of Artificial Sequence: Target Sequence/siNA sense region
ccaaccgccgcccacagga

SEQ ID NO: 449 - RNA, 19 nt, Artificial Sequence
  Description of Artificial Sequence: Target Sequence/siNA sense region
accaaccgccgcccacagg

SEQ ID NO: 450 - RNA, 19 nt, Artificial Sequence
  Description of Artificial Sequence: Target Sequence/siNA sense region
uggaguuuaccuguugccg

SEQ ID NO: 451 - RNA, 19 nt, Artificial Sequence
  Description of Artificial Sequence: Target Sequence/siNA sense region
caccaaccgccgcccacag

SEQ ID NO: 452 - RNA, 19 nt, Artificial Sequence
  Description of Artificial Sequence: Target Sequence/siNA sense region
caaacguaacaccaaccgc

SEQ ID NO: 453 - RNA, 19 nt, Artificial Sequence
  Description of Artificial Sequence: Target Sequence/siNA sense region
caagcggagacggcuggag

SEQ ID NO: 454 - RNA, 19 nt, Artificial Sequence
  Description of Artificial Sequence: Target Sequence/siNA sense region
acggaggcuaugacuaggu

SEQ ID NO: 455 - RNA, 19 nt, Artificial Sequence
  Description of Artificial Sequence: Target Sequence/siNA sense region
uaacaccaaccgccgccca

SEQ ID NO: 456 - RNA, 19 nt, Artificial Sequence
  Description of Artificial Sequence: Target Sequence/siNA sense region
aucguugguggaguuuacc

SEQ ID NO: 457 - RNA, 19 nt, Artificial Sequence
  Description of Artificial Sequence: Target Sequence/siNA sense region
gggagacauauaucacagc

SEQ ID NO: 458 - RNA, 19 nt, Artificial Sequence
  Description of Artificial Sequence: Target Sequence/siNA sense region
aaccucguggaaggcgaca

SEQ ID NO: 459 - RNA, 19 nt, Artificial Sequence
  Description of Artificial Sequence: Target Sequence/siNA sense region
gggggagacauauaucaca

SEQ ID NO: 460 - RNA, 19 nt, Artificial Sequence
  Description of Artificial Sequence: Target Sequence/siNA sense region
aacguaacaccaaccgccg

SEQ ID NO: 461 - RNA, 19 nt, Artificial Sequence
  Description of Artificial Sequence: Target Sequence/siNA sense region
aaacguaacaccaaccgcc

SEQ ID NO: 462 - RNA, 19 nt, Artificial Sequence
  Description of Artificial Sequence: Target Sequence/siNA sense region
ggggagacauauaucacag

SEQ ID NO: 463 - RNA, 19 nt, Artificial Sequence
  Description of Artificial Sequence: Target Sequence/siNA sense region
gagaugaaggcgaaggcgu

SEQ ID NO: 464 - RNA, 19 nt, Artificial Sequence
  Description of Artificial Sequence: Target Sequence/siNA sense region
aagcggagacggcuggagc

SEQ ID NO: 465 - RNA, 19 nt, Artificial Sequence
  Description of Artificial Sequence: Target Sequence/siNA sense region
guacccuuggccccucuau

SEQ ID NO: 466 - RNA, 19 nt, Artificial Sequence
  Description of Artificial Sequence: Target Sequence/siNA sense region
ccuccaggacccccccucc

SEQ ID NO: 467 - RNA, 19 nt, Artificial Sequence
  Description of Artificial Sequence: Target Sequence/siNA sense region
cuccaggacccccccuccc

SEQ ID NO: 468 - RNA, 19 nt, Artificial Sequence
  Description of Artificial Sequence: Target Sequence/siNA sense region
uacccuuggccccucuaug

SEQ ID NO: 469 - RNA, 19 nt, Artificial Sequence
  Description of Artificial Sequence: Target Sequence/siNA sense region
caaccucguggaaggcgac

SEQ ID NO: 470 - RNA, 19 nt, Artificial Sequence
  Description of Artificial Sequence: Target Sequence/siNA sense region
cggaggcuaugacuaggua

SEQ ID NO: 471 - RNA, 19 nt, Artificial Sequence
  Description of Artificial Sequence: Target Sequence/siNA sense region
ggagaugaaggcgaaggcg

SEQ ID NO: 472 - RNA, 19 nt, Artificial Sequence
  Description of Artificial Sequence: Target Sequence/siNA sense region
agaugaaggcgaaggcguc

SEQ ID NO: 473 - RNA, 19 nt, Artificial Sequence
  Description of Artificial Sequence: Target Sequence/siNA sense region
guaacaccaaccgccgccc

SEQ ID NO: 474 - RNA, 19 nt, Artificial Sequence
  Description of Artificial Sequence: Target Sequence/siNA sense region
cguaacaccaaccgccgcc

SEQ ID NO: 475 - RNA, 19 nt, Artificial Sequence
  Description of Artificial Sequence: Target Sequence/siNA sense region
acguaacaccaaccgccgc

SEQ ID NO: 476 - RNA, 19 nt, Artificial Sequence
  Description of Artificial Sequence: Target Sequence/siNA sense region
cacggaggcuaugacuagg

SEQ ID NO: 477 - RNA, 19 nt, Artificial Sequence
  Description of Artificial Sequence: Target Sequence/siNA sense region
guugguggaguuuaccugu

SEQ ID NO: 478 - RNA, 19 nt, Artificial Sequence
  Description of Artificial Sequence: Target Sequence/siNA sense region
cguugguggaguuuaccug

SEQ ID NO: 479 - RNA, 19 nt, Artificial Sequence
  Description of Artificial Sequence: Target Sequence/siNA sense region
acccuuggccccucuaugg

SEQ ID NO: 480 - RNA, 19 nt, Artificial Sequence
  Description of Artificial Sequence: Target Sequence/siNA sense region
uugguggaguuuaccuguu

SEQ ID NO: 481 - RNA, 19 nt, Artificial Sequence
  Description of Artificial Sequence: Target Sequence/siNA sense region
ugguggaguuuaccuguug

SEQ ID NO: 482 - RNA, 19 nt, Artificial Sequence
  Description of Artificial Sequence: Target Sequence/siNA sense region
ucguugguggaguuuaccu

SEQ ID NO: 483 - RNA, 19 nt, Artificial Sequence
  Description of Artificial Sequence: Target Sequence/siNA sense region
cggguacccuuggccccuc

SEQ ID NO: 484 - RNA, 19 nt, Artificial Sequence
  Description of Artificial Sequence: Target Sequence/siNA sense region
ggcucagcccggguacccu

SEQ ID NO: 485 - RNA, 19 nt, Artificial Sequence
  Description of Artificial Sequence: Target Sequence/siNA sense region
gaucacuccccugugagga

SEQ ID NO: 486 - RNA, 19 nt, Artificial Sequence
  Description of Artificial Sequence: Target Sequence/siNA sense region
gguggucagaucguuggug

SEQ ID NO: 487 - RNA, 19 nt, Artificial Sequence
  Description of Artificial Sequence: Target Sequence/siNA sense region
gaugaaggcgaaggcgucc

SEQ ID NO: 488 - RNA, 19 nt, Artificial Sequence
  Description of Artificial Sequence: Target Sequence/siNA sense region
aggauggcuccugucaccc

SEQ ID NO: 489 - RNA, 19 nt, Artificial Sequence
  Description of Artificial Sequence: Target Sequence/siNA sense region
cucagcccggguacccuug

SEQ ID NO: 490 - RNA, 19 nt, Artificial Sequence
  Description of Artificial Sequence: Target Sequence/siNA sense region
ucagcccggguacccuugg

SEQ ID NO: 491 - RNA, 19 nt, Artificial Sequence
  Description of Artificial Sequence: Target Sequence/siNA sense region
augaaggcgaaggcgucca

SEQ ID NO: 492 - RNA, 19 nt, Artificial Sequence
  Description of Artificial Sequence: Target Sequence/siNA sense region
cgggggagacauauaucac

SEQ ID NO: 493 - RNA, 19 nt, Artificial Sequence
  Description of Artificial Sequence: Target Sequence/siNA sense region
caggauggcuccugucacc

SEQ ID NO: 494 - RNA, 19 nt, Artificial Sequence
  Description of Artificial Sequence: Target Sequence/siNA sense region
ugaaggcgaaggcguccac

SEQ ID NO: 495 - RNA, 19 nt, Artificial Sequence
  Description of Artificial Sequence: Target Sequence/siNA sense region
uggucagaucguuggugga

SEQ ID NO: 496 - RNA, 19 nt, Artificial Sequence
  Description of Artificial Sequence: Target Sequence/siNA sense region
gcucagcccggguacccuu

SEQ ID NO: 497 - RNA, 19 nt, Artificial Sequence
  Description of Artificial Sequence: Target Sequence/siNA sense region
guggucagaucguuggugg

SEQ ID NO: 498 - RNA, 19 nt, Artificial Sequence
  Description of Artificial Sequence: Target Sequence/siNA sense region
cagccuccaggaccccccc

SEQ ID NO: 499 - RNA, 19 nt, Artificial Sequence
  Description of Artificial Sequence: Target Sequence/siNA sense region
ggcgguggucagaucguug

SEQ ID NO: 500 - RNA, 19 nt, Artificial Sequence
  Description of Artificial Sequence: Target Sequence/siNA sense region
gccuccaggacccccccuc

SEQ ID NO: 501 - RNA, 19 nt, Artificial Sequence
  Description of Artificial Sequence: Target Sequence/siNA sense region
aaccggcugauagcguucg

SEQ ID NO: 502 - RNA, 19 nt, Artificial Sequence
  Description of Artificial Sequence: Target Sequence/siNA sense region
agccuccaggacccccccu

SEQ ID NO: 503 - RNA, 19 nt, Artificial Sequence
  Description of Artificial Sequence: Target Sequence/siNA sense region
cggcuucgccgaccucaug

SEQ ID NO: 504 - RNA, 19 nt, Artificial Sequence
  Description of Artificial Sequence: Target Sequence/siNA sense region
gcggagacggcuggagcgc

SEQ ID NO: 505 - RNA, 19 nt, Artificial Sequence
  Description of Artificial Sequence: Target Sequence/siNA sense region
ucaugggguacauuccgcu

SEQ ID NO: 506 - RNA, 19 nt, Artificial Sequence
  Description of Artificial Sequence: Target Sequence/siNA sense region
gaaccggcugauagcguuc

SEQ ID NO: 507 - RNA, 19 nt, Artificial Sequence
  Description of Artificial Sequence: Target Sequence/siNA sense region
gcgguggucagaucguugg

SEQ ID NO: 508 - RNA, 19 nt, Artificial Sequence
  Description of Artificial Sequence: Target Sequence/siNA sense region
ggcaggauggcuccuguca

SEQ ID NO: 509 - RNA, 19 nt, Artificial Sequence
  Description of Artificial Sequence: Target Sequence/siNA sense region
gcaggauggcuccugucac

SEQ ID NO: 510 - RNA, 19 nt, Artificial Sequence
  Description of Artificial Sequence: Target Sequence/siNA sense region
auuuggguaaggucaucga

SEQ ID NO: 511 - RNA, 19 nt, Artificial Sequence
  Description of Artificial Sequence: Target Sequence/siNA sense region
accggcugauagcguucgc

SEQ ID NO: 512 - RNA, 19 nt, Artificial Sequence
  Description of Artificial Sequence: Target Sequence/siNA sense region
cggagacggcuggagcgcg

SEQ ID NO: 513 - RNA, 19 nt, Artificial Sequence
  Description of Artificial Sequence: Target Sequence/siNA sense region
gcggcuucgccgaccucau

SEQ ID NO: 514 - RNA, 19 nt, Artificial Sequence
  Description of Artificial Sequence: Target Sequence/siNA sense region
aauuuggguaaggucaucg

SEQ ID NO: 515 - RNA, 19 nt, Artificial Sequence
  Description of Artificial Sequence: Target Sequence/siNA sense region
gggcgguggucagaucguu

SEQ ID NO: 516 - RNA, 19 nt, Artificial Sequence
  Description of Artificial Sequence: Target Sequence/siNA sense region
caaccgccgcccacaggac

SEQ ID NO: 517 - RNA, 19 nt, Artificial Sequence
  Description of Artificial Sequence: Target Sequence/siNA sense region
ugcggcuucgccgaccuca

SEQ ID NO: 518 - RNA, 19 nt, Artificial Sequence
  Description of Artificial Sequence: Target Sequence/siNA sense region
cgguggucagaucguuggu

SEQ ID NO: 519 - RNA, 19 nt, Artificial Sequence
  Description of Artificial Sequence: Target Sequence/siNA sense region
uugggugugcgcgcgacua

SEQ ID NO: 520 - RNA, 19 nt, Artificial Sequence
  Description of Artificial Sequence: Target Sequence/siNA sense region
gugugcgcgcgacuaggaa

SEQ ID NO: 521 - RNA, 19 nt, Artificial Sequence
  Description of Artificial Sequence: Target Sequence/siNA sense region
gauggcuccugucaccccg

SEQ ID NO: 522 - RNA, 19 nt, Artificial Sequence
  Description of Artificial Sequence: Target Sequence/siNA sense region
ggauggcuccugucacccc

SEQ ID NO: 523 - RNA, 19 nt, Artificial Sequence
  Description of Artificial Sequence: Target Sequence/siNA sense region
ugugcgcgcgacuaggaag

SEQ ID NO: 524 - RNA, 19 nt, Artificial Sequence
  Description of Artificial Sequence: Target Sequence/siNA sense region
ugggugugcgcgcgacuag

SEQ ID NO: 525 - RNA, 19 nt, Artificial Sequence
  Description of Artificial Sequence: Target Sequence/siNA sense region
ggugugcgcgcgacuagga

SEQ ID NO: 526 - RNA, 19 nt, Artificial Sequence
  Description of Artificial Sequence: Target Sequence/siNA sense region
gggugugcgcgcgacuagg

SEQ ID NO: 527 - RNA, 19 nt, Artificial Sequence
  Description of Artificial Sequence: Target Sequence/siNA sense region
ccccggcguaggucgcgua

SEQ ID NO: 528 - RNA, 19 nt, Artificial Sequence
  Description of Artificial Sequence: Target Sequence/siNA sense region
gaaggcgacaaccuauccc

SEQ ID NO: 529 - RNA, 19 nt, Artificial Sequence
  Description of Artificial Sequence: Target Sequence/siNA sense region
cccggcguaggucgcguaa

SEQ ID NO: 530 - RNA, 19 nt, Artificial Sequence
  Description of Artificial Sequence: Target Sequence/siNA sense region
agcggagacggcuggagcg

SEQ ID NO: 531 - RNA, 19 nt, Artificial Sequence
  Description of Artificial Sequence: Target Sequence/siNA sense region
cccccggcguaggucgcgu

SEQ ID NO: 532 - RNA, 19 nt, Artificial Sequence
  Description of Artificial Sequence: Target Sequence/siNA sense region
aggcgaaggcguccacagu

SEQ ID NO: 533 - RNA, 19 nt, Artificial Sequence
  Description of Artificial Sequence: Target Sequence/siNA sense region
aaggcgaaggcguccacag

SEQ ID NO: 534 - RNA, 19 nt, Artificial Sequence
  Description of Artificial Sequence: Target Sequence/siNA sense region
guugggugugcgcgcgacu

SEQ ID NO: 535 - RNA, 19 nt, Artificial Sequence
  Description of Artificial Sequence: Target Sequence/siNA sense region
cucaugggguacauuccgc

SEQ ID NO: 536 - RNA, 19 nt, Artificial Sequence
  Description of Artificial Sequence: Target Sequence/siNA sense region
ggaaggcgacaaccuaucc

SEQ ID NO: 537 - RNA, 19 nt, Artificial Sequence
  Description of Artificial Sequence: Target Sequence/siNA sense region
gcaaguuccuugccgacgg

SEQ ID NO: 538 - RNA, 19 nt, Artificial Sequence
  Description of Artificial Sequence: Target Sequence/siNA sense region
ugcagccuccaggaccccc

SEQ ID NO: 539 - RNA, 19 nt, Artificial Sequence
  Description of Artificial Sequence: Target Sequence/siNA sense region
ggacugcacgaugcucgug

SEQ ID NO: 540 - RNA, 19 nt, Artificial Sequence
  Description of Artificial Sequence: Target Sequence/siNA sense region
gaaggcgaaggcguccaca

SEQ ID NO: 541 - RNA, 19 nt, Artificial Sequence
  Description of Artificial Sequence: Target Sequence/siNA sense region
gcaaccucguggaaggcga

SEQ ID NO: 542 - RNA, 19 nt, Artificial Sequence
  Description of Artificial Sequence: Target Sequence/siNA sense region
gacgcgggcugugcuuggu

SEQ ID NO: 543 - RNA, 19 nt, Artificial Sequence
  Description of Artificial Sequence: Target Sequence/siNA sense region
acgcgggcugugcuuggua

SEQ ID NO: 544 - RNA, 19 nt, Artificial Sequence
  Description of Artificial Sequence: Target Sequence/siNA sense region
gugcagccuccaggacccc

SEQ ID NO: 545 - RNA, 19 nt, Artificial Sequence
  Description of Artificial Sequence: Target Sequence/siNA sense region
gcagccuccaggacccccc

SEQ ID NO: 546 - RNA, 19 nt, Artificial Sequence
  Description of Artificial Sequence: Target Sequence/siNA sense region
cgcaaccucguggaaggcg

SEQ ID NO: 547 - RNA, 19 nt, Artificial Sequence
  Description of Artificial Sequence: Target Sequence/siNA sense region
ugucgugcagccuccagga

SEQ ID NO: 548 - RNA, 19 nt, Artificial Sequence
  Description of Artificial Sequence: Target Sequence/siNA sense region
auggcuugggauaugauga

SEQ ID NO: 549 - RNA, 19 nt, Artificial Sequence
  Description of Artificial Sequence: Target Sequence/siNA sense region
cuugggauaugaugaugaa

SEQ ID NO: 550 - RNA, 19 nt, Artificial Sequence
  Description of Artificial Sequence: Target Sequence/siNA sense region
cccuuggccccucuauggc

SEQ ID NO: 551 - RNA, 19 nt, Artificial Sequence
  Description of Artificial Sequence: Target Sequence/siNA sense region
uggcuugggauaugaugau

SEQ ID NO: 552 - RNA, 19 nt, Artificial Sequence
  Description of Artificial Sequence: Target Sequence/siNA sense region
cugugcaguggaugaaccg

SEQ ID NO: 553 - RNA, 19 nt, Artificial Sequence
  Description of Artificial Sequence: Target Sequence/siNA sense region
augacgcgggcugugcuug

SEQ ID NO: 554 - RNA, 19 nt, Artificial Sequence
  Description of Artificial Sequence: Target Sequence/siNA sense region
gcuugggauaugaugauga

SEQ ID NO: 555 - RNA, 19 nt, Artificial Sequence
  Description of Artificial Sequence: Target Sequence/siNA sense region
uaugacgcgggcugugcuu

SEQ ID NO: 556 - RNA, 19 nt, Artificial Sequence
  Description of Artificial Sequence: Target Sequence/siNA sense region
ugacgcgggcugugcuugg

SEQ ID NO: 557 - RNA, 19 nt, Artificial Sequence
  Description of Artificial Sequence: Target Sequence/siNA sense region
ggcuugggauaugaugaug

SEQ ID NO: 558 - RNA, 19 nt, Artificial Sequence
  Description of Artificial Sequence: Target Sequence/siNA sense region
ugugcaguggaugaaccgg

SEQ ID NO: 559 - RNA, 19 nt, Artificial Sequence
  Description of Artificial Sequence: Target Sequence/siNA sense region
gcugugcaguggaugaacc

SEQ ID NO: 560 - RNA, 19 nt, Artificial Sequence
  Description of Artificial Sequence: Target Sequence/siNA sense region
cucuucaacugggcaguaa

SEQ ID NO: 561 - RNA, 19 nt, Artificial Sequence
  Description of Artificial Sequence: Target Sequence/siNA sense region
ccucguggaaggcgacaac

SEQ ID NO: 562 - RNA, 19 nt, Artificial Sequence
  Description of Artificial Sequence: Target Sequence/siNA sense region
ugugucacccagacagucg

SEQ ID NO: 563 - RNA, 19 nt, Artificial Sequence
  Description of Artificial Sequence: Target Sequence/siNA sense region
ggcgugaacuaugcaacag

SEQ ID NO: 564 - RNA, 19 nt, Artificial Sequence
  Description of Artificial Sequence: Target Sequence/siNA sense region
cggcgugaacuaugcaaca

SEQ ID NO: 565 - RNA, 19 nt, Artificial Sequence
  Description of Artificial Sequence: Target Sequence/siNA sense region
gugucacccagacagucga

SEQ ID NO: 566 - RNA, 19 nt, Artificial Sequence
  Description of Artificial Sequence: Target Sequence/siNA sense region
ccucuucaacugggcagua

SEQ ID NO: 567 - RNA, 19 nt, Artificial Sequence
  Description of Artificial Sequence: Target Sequence/siNA sense region
cguggaaggcgacaaccua

SEQ ID NO: 568 - RNA, 19 nt, Artificial Sequence
  Description of Artificial Sequence: Target Sequence/siNA sense region
ucguggaaggcgacaaccu

SEQ ID NO: 569 - RNA, 19 nt, Artificial Sequence
  Description of Artificial Sequence: Target Sequence/siNA sense region
cggccuaguuggggcccca

SEQ ID NO: 570 - RNA, 19 nt, Artificial Sequence
  Description of Artificial Sequence: Target Sequence/siNA sense region
cgacuaggaagacuuccga

SEQ ID NO: 571 - RNA, 19 nt, Artificial Sequence
  Description of Artificial Sequence: Target Sequence/siNA sense region
uuuggguaaggucaucgau

SEQ ID NO: 572 - RNA, 19 nt, Artificial Sequence
  Description of Artificial Sequence: Target Sequence/siNA sense region
guggaaggcgacaaccuau

SEQ ID NO: 573 - RNA, 19 nt, Artificial Sequence
  Description of Artificial Sequence: Target Sequence/siNA sense region
accucguggaaggcgacaa

SEQ ID NO: 574 - RNA, 19 nt, Artificial Sequence
  Description of Artificial Sequence: Target Sequence/siNA sense region
gcgacuaggaagacuuccg

SEQ ID NO: 575 - RNA, 19 nt, Artificial Sequence
  Description of Artificial Sequence: Target Sequence/siNA sense region
gucgugcagccuccaggac

SEQ ID NO: 576 - RNA, 19 nt, Artificial Sequence
  Description of Artificial Sequence: Target Sequence/siNA sense region
uaggaagacuuccgagcgg

SEQ ID NO: 577 - RNA, 19 nt, Artificial Sequence
  Description of Artificial Sequence: Target Sequence/siNA sense region
acggcgugaacuaugcaac

SEQ ID NO: 578 - RNA, 19 nt, Artificial Sequence
  Description of Artificial Sequence: Target Sequence/siNA sense region
cucguggaaggcgacaacc

SEQ ID NO: 579 - RNA, 19 nt, Artificial Sequence
  Description of Artificial Sequence: Target Sequence/siNA sense region
ggucgcaaccucguggaag

SEQ ID NO: 580 - RNA, 19 nt, Artificial Sequence
  Description of Artificial Sequence: Target Sequence/siNA sense region
cggucgcaaccucguggaa

SEQ ID NO: 581 - RNA, 19 nt, Artificial Sequence
  Description of Artificial Sequence: Target Sequence/siNA sense region
gcgcgcgacuaggaagacu

SEQ ID NO: 582 - RNA, 19 nt, Artificial Sequence
  Description of Artificial Sequence: Target Sequence/siNA sense region
gacggcgugaacuaugcaa

SEQ ID NO: 583 - RNA, 19 nt, Artificial Sequence
  Description of Artificial Sequence: Target Sequence/siNA sense region
uagaucacuccccugugag

SEQ ID NO: 584 - RNA, 19 nt, Artificial Sequence
  Description of Artificial Sequence: Target Sequence/siNA sense region
agcggucgcaaccucgugg

SEQ ID NO: 585 - RNA, 19 nt, Artificial Sequence
  Description of Artificial Sequence: Target Sequence/siNA sense region
uggaaggcgacaaccuauc

SEQ ID NO: 586 - RNA, 19 nt, Artificial Sequence
  Description of Artificial Sequence: Target Sequence/siNA sense region
cgcgcgacuaggaagacuu

SEQ ID NO: 587 - RNA, 19 nt, Artificial Sequence
  Description of Artificial Sequence: Target Sequence/siNA sense region
cuaggaagacuuccgagcg

SEQ ID NO: 588 - RNA, 19 nt, Artificial Sequence
  Description of Artificial Sequence: Target Sequence/siNA sense region
gugcgcgcgacuaggaaga

SEQ ID NO: 589 - RNA, 19 nt, Artificial Sequence
  Description of Artificial Sequence: Target Sequence/siNA sense region
agaucacuccccugugagg

SEQ ID NO: 590 - RNA, 19 nt, Artificial Sequence
  Description of Artificial Sequence: Target Sequence/siNA sense region
ugcgcgcgacuaggaagac

SEQ ID NO: 591 - RNA, 19 nt, Artificial Sequence
  Description of Artificial Sequence: Target Sequence/siNA sense region
auagaucacuccccuguga

SEQ ID NO: 592 - RNA, 19 nt, Artificial Sequence
  Description of Artificial Sequence: Target Sequence/siNA sense region
gagcggucgcaaccucgug

SEQ ID NO: 593 - RNA, 19 nt, Artificial Sequence
  Description of Artificial Sequence: Target Sequence/siNA sense region
cacgaacgacugcuccaac

SEQ ID NO: 594 - RNA, 19 nt, Artificial Sequence
  Description of Artificial Sequence: Target Sequence/siNA sense region
ggcaaguuccuugccgacg

SEQ ID NO: 595 - RNA, 19 nt, Artificial Sequence
  Description of Artificial Sequence: Target Sequence/siNA sense region
ucgugcagccuccaggacc

SEQ ID NO: 596 - RNA, 19 nt, Artificial Sequence
  Description of Artificial Sequence: Target Sequence/siNA sense region
gucacgaacgacugcucca

SEQ ID NO: 597 - RNA, 19 nt, Artificial Sequence
  Description of Artificial Sequence: Target Sequence/siNA sense region
gcggucgcaaccucgugga

SEQ ID NO: 598 - RNA, 19 nt, Artificial Sequence
  Description of Artificial Sequence: Target Sequence/siNA sense region
gcgcgacuaggaagacuuc

SEQ ID NO: 599 - RNA, 19 nt, Artificial Sequence
  Description of Artificial Sequence: Target Sequence/siNA sense region
gcuaugacgcgggcugugc

SEQ ID NO: 600 - RNA, 19 nt, Artificial Sequence
  Description of Artificial Sequence: Target Sequence/siNA sense region
ucacgaacgacugcuccaa

SEQ ID NO: 601 - RNA, 19 nt, Artificial Sequence
  Description of Artificial Sequence: Target Sequence/siNA sense region
ucgcaaccucguggaaggc

SEQ ID NO: 602 - RNA, 19 nt, Artificial Sequence
  Description of Artificial Sequence: Target Sequence/siNA sense region
cgugcagccuccaggaccc

SEQ ID NO: 603 - RNA, 19 nt, Artificial Sequence
  Description of Artificial Sequence: Target Sequence/siNA sense region
gucgcaaccucguggaagg

SEQ ID NO: 604 - RNA, 19 nt, Artificial Sequence
  Description of Artificial Sequence: Target Sequence/siNA sense region
acuaggaagacuuccgagc

SEQ ID NO: 605 - RNA, 19 nt, Artificial Sequence
  Description of Artificial Sequence: Target Sequence/siNA sense region
cgcgacuaggaagacuucc

SEQ ID NO: 606 - RNA, 19 nt, Artificial Sequence
  Description of Artificial Sequence: Target Sequence/siNA sense region
ugggcgaagcacaugugga

SEQ ID NO: 607 - RNA, 19 nt, Artificial Sequence
  Description of Artificial Sequence: Target Sequence/siNA sense region
ccuugccuacuauuccaug

SEQ ID NO: 608 - RNA, 19 nt, Artificial Sequence
  Description of Artificial Sequence: Target Sequence/siNA sense region
gccucaggaaacuuggggu

SEQ ID NO: 609 - RNA, 19 nt, Artificial Sequence
  Description of Artificial Sequence: Target Sequence/siNA sense region
ugcuaugacgcgggcugug

SEQ ID NO: 610 - RNA, 19 nt, Artificial Sequence
  Description of Artificial Sequence: Target Sequence/siNA sense region
ucgugcucgccaccgcuac

SEQ ID NO: 611 - RNA, 19 nt, Artificial Sequence
  Description of Artificial Sequence: Target Sequence/siNA sense region
ugccucaggaaacuugggg

SEQ ID NO: 612 - RNA, 19 nt, Artificial Sequence
  Description of Artificial Sequence: Target Sequence/siNA sense region
ugucucgugcccgaccccg

SEQ ID NO: 613 - RNA, 19 nt, Artificial Sequence
  Description of Artificial Sequence: Target Sequence/siNA sense region
uguggcggcaggagauggg

SEQ ID NO: 614 - RNA, 19 nt, Artificial Sequence
  Description of Artificial Sequence: Target Sequence/siNA sense region
gucgugcucgccaccgcua

SEQ ID NO: 615 - RNA, 19 nt, Artificial Sequence
  Description of Artificial Sequence: Target Sequence/siNA sense region
gauuuccacuacgugacgg

SEQ ID NO: 616 - RNA, 19 nt, Artificial Sequence
  Description of Artificial Sequence: Target Sequence/siNA sense region
gggccuugccuacuauucc

SEQ ID NO: 617 - RNA, 19 nt, Artificial Sequence
  Description of Artificial Sequence: Target Sequence/siNA sense region
gccuugccuacuauuccau

SEQ ID NO: 618 - RNA, 19 nt, Artificial Sequence
  Description of Artificial Sequence: Target Sequence/siNA sense region
gacuaggaagacuuccgag

SEQ ID NO: 619 - RNA, 19 nt, Artificial Sequence
  Description of Artificial Sequence: Target Sequence/siNA sense region
gcgggggagacauauauca

SEQ ID NO: 620 - RNA, 19 nt, Artificial Sequence
  Description of Artificial Sequence: Target Sequence/siNA sense region
cgagcggucgcaaccucgu

SEQ ID NO: 621 - RNA, 19 nt, Artificial Sequence
  Description of Artificial Sequence: Target Sequence/siNA sense region
ggccuugccuacuauucca

SEQ ID NO: 622 - RNA, 19 nt, Artificial Sequence
  Description of Artificial Sequence: Target Sequence/siNA sense region
auuuccacuacgugacggg

SEQ ID NO: 623 - RNA, 19 nt, Artificial Sequence
  Description of Artificial Sequence: Target Sequence/siNA sense region
ggacgucaaguucccgggc

SEQ ID NO: 624 - RNA, 19 nt, Artificial Sequence
  Description of Artificial Sequence: Target Sequence/siNA sense region
gagugcuaugacgcgggcu

SEQ ID NO: 625 - RNA, 19 nt, Artificial Sequence
  Description of Artificial Sequence: Target Sequence/siNA sense region
gacgucaaguucccgggcg

SEQ ID NO: 626 - RNA, 19 nt, Artificial Sequence
  Description of Artificial Sequence: Target Sequence/siNA sense region
ucagcgacgggucuugguc

SEQ ID NO: 627 - RNA, 19 nt, Artificial Sequence
  Description of Artificial Sequence: Target Sequence/siNA sense region
ucaaguucccgggcggugg

SEQ ID NO: 628 - RNA, 19 nt, Artificial Sequence
  Description of Artificial Sequence: Target Sequence/siNA sense region
ucaaggagaugaaggcgaa

SEQ ID NO: 629 - RNA, 19 nt, Artificial Sequence
  Description of Artificial Sequence: Target Sequence/siNA sense region
ccuauccccaaggcucgcc

SEQ ID NO: 630 - RNA, 19 nt, Artificial Sequence
  Description of Artificial Sequence: Target Sequence/siNA sense region
cuugaccuaccucagauca

SEQ ID NO: 631 - RNA, 19 nt, Artificial Sequence
  Description of Artificial Sequence: Target Sequence/siNA sense region
uuuccacuacgugacgggc

SEQ ID NO: 632 - RNA, 19 nt, Artificial Sequence
  Description of Artificial Sequence: Target Sequence/siNA sense region
agugcuaugacgcgggcug

SEQ ID NO: 633 - RNA, 19 nt, Artificial Sequence
  Description of Artificial Sequence: Target Sequence/siNA sense region
acgucaaguucccgggcgg

SEQ ID NO: 634 - RNA, 19 nt, Artificial Sequence
  Description of Artificial Sequence: Target Sequence/siNA sense region
ucuggagacaucgggccag

SEQ ID NO: 635 - RNA, 19 nt, Artificial Sequence
  Description of Artificial Sequence: Target Sequence/siNA sense region
gggcgaagcacauguggaa

SEQ ID NO: 636 - RNA, 19 nt, Artificial Sequence
  Description of Artificial Sequence: Target Sequence/siNA sense region
uugaccuaccucagaucau

SEQ ID NO: 637 - RNA, 19 nt, Artificial Sequence
  Description of Artificial Sequence: Target Sequence/siNA sense region
ccaagcggagacggcugga

SEQ ID NO: 638 - RNA, 19 nt, Artificial Sequence
  Description of Artificial Sequence: Target Sequence/siNA sense region
accaagcggagacggcugg

SEQ ID NO: 639 - RNA, 19 nt, Artificial Sequence
  Description of Artificial Sequence: Target Sequence/siNA sense region
ggguggcuucaugccucag

SEQ ID NO: 640 - RNA, 19 nt, Artificial Sequence
  Description of Artificial Sequence: Target Sequence/siNA sense region
gucaaguucccgggcggug

SEQ ID NO: 641 - RNA, 19 nt, Artificial Sequence
  Description of Artificial Sequence: Target Sequence/siNA sense region
cucaaggagaugaaggcga

SEQ ID NO: 642 - RNA, 19 nt, Artificial Sequence
  Description of Artificial Sequence: Target Sequence/siNA sense region
gaccaagcggagacggcug

SEQ ID NO: 643 - RNA, 19 nt, Artificial Sequence
  Description of Artificial Sequence: Target Sequence/siNA sense region
uccaggucgggcucaacca

SEQ ID NO: 644 - RNA, 19 nt, Artificial Sequence
  Description of Artificial Sequence: Target Sequence/siNA sense region
cucuuucucuaucuuccuc

SEQ ID NO: 645 - RNA, 19 nt, Artificial Sequence
  Description of Artificial Sequence: Target Sequence/siNA sense region
gucuggagacaucgggcca

SEQ ID NO: 646 - RNA, 19 nt, Artificial Sequence
  Description of Artificial Sequence: Target Sequence/siNA sense region
guugugacuuggcccccga

SEQ ID NO: 647 - RNA, 19 nt, Artificial Sequence
  Description of Artificial Sequence: Target Sequence/siNA sense region
agaccuggcuccaguccaa

SEQ ID NO: 648 - RNA, 19 nt, Artificial Sequence
  Description of Artificial Sequence: Target Sequence/siNA sense region
cuugccuacuauuccaugg

SEQ ID NO: 649 - RNA, 19 nt, Artificial Sequence
  Description of Artificial Sequence: Target Sequence/siNA sense region
cccgguugcucuuucucua

SEQ ID NO: 650 - RNA, 19 nt, Artificial Sequence
  Description of Artificial Sequence: Target Sequence/siNA sense region
cuuucucuaucuuccucuu

SEQ ID NO: 651 - RNA, 19 nt, Artificial Sequence
  Description of Artificial Sequence: Target Sequence/siNA sense region
aggguggcuucaugccuca

SEQ ID NO: 652 - RNA, 19 nt, Artificial Sequence
  Description of Artificial Sequence: Target Sequence/siNA sense region
aagaccuggcuccagucca

SEQ ID NO: 653 - RNA, 19 nt, Artificial Sequence
  Description of Artificial Sequence: Target Sequence/siNA sense region
ccgguugcucuuucucuau

SEQ ID NO: 654 - RNA, 19 nt, Artificial Sequence
  Description of Artificial Sequence: Target Sequence/siNA sense region
cgguugcucuuucucuauc

SEQ ID NO: 655 - RNA, 19 nt, Artificial Sequence
  Description of Artificial Sequence: Target Sequence/siNA sense region
ugggggauuuccacuacgu

SEQ ID NO: 656 - RNA, 19 nt, Artificial Sequence
  Description of Artificial Sequence: Target Sequence/siNA sense region
augucacgaacgacugcuc

SEQ ID NO: 657 - RNA, 19 nt, Artificial Sequence
  Description of Artificial Sequence: Target Sequence/siNA sense region
ggccuaguuggggccccac

SEQ ID NO: 658 - RNA, 19 nt, Artificial Sequence
  Description of Artificial Sequence: Target Sequence/siNA sense region
uggaccaagcggagacggc

SEQ ID NO: 659 - RNA, 19 nt, Artificial Sequence
  Description of Artificial Sequence: Target Sequence/siNA sense region
uuccaggucgggcucaacc

SEQ ID NO: 660 - RNA, 19 nt, Artificial Sequence
  Description of Artificial Sequence: Target Sequence/siNA sense region
agcgggucgaguuccuggu

SEQ ID NO: 661 - RNA, 19 nt, Artificial Sequence
  Description of Artificial Sequence: Target Sequence/siNA sense region
caaggagaugaaggcgaag

SEQ ID NO: 662 - RNA, 19 nt, Artificial Sequence
  Description of Artificial Sequence: Target Sequence/siNA sense region
caugucacgaacgacugcu

SEQ ID NO: 663 - RNA, 19 nt, Artificial Sequence
  Description of Artificial Sequence: Target Sequence/siNA sense region
cagcgggucgaguuccugg

SEQ ID NO: 664 - RNA, 19 nt, Artificial Sequence
  Description of Artificial Sequence: Target Sequence/siNA sense region
uuccacuacgugacgggca

SEQ ID NO: 665 - RNA, 19 nt, Artificial Sequence
  Description of Artificial Sequence: Target Sequence/siNA sense region
uaggguggcuucaugccuc

SEQ ID NO: 666 - RNA, 19 nt, Artificial Sequence
  Description of Artificial Sequence: Target Sequence/siNA sense region
uccaggacugcacgaugcu

SEQ ID NO: 667 - RNA, 19 nt, Artificial Sequence
  Description of Artificial Sequence: Target Sequence/siNA sense region
uccacuacgugacgggcau

SEQ ID NO: 668 - RNA, 19 nt, Artificial Sequence
  Description of Artificial Sequence: Target Sequence/siNA sense region
aauaggguggcuucaugcc

SEQ ID NO: 669 - RNA, 19 nt, Artificial Sequence
  Description of Artificial Sequence: Target Sequence/siNA sense region
gucuucacggaggcuauga

SEQ ID NO: 670 - RNA, 19 nt, Artificial Sequence
  Description of Artificial Sequence: Target Sequence/siNA sense region
auaggguggcuucaugccu

SEQ ID NO: 671 - RNA, 19 nt, Artificial Sequence
  Description of Artificial Sequence: Target Sequence/siNA sense region
ucuucacggaggcuaugac

SEQ ID NO: 672 - RNA, 19 nt, Artificial Sequence
  Description of Artificial Sequence: Target Sequence/siNA sense region
augccucaggaaacuuggg

SEQ ID NO: 673 - RNA, 19 nt, Artificial Sequence
  Description of Artificial Sequence: Target Sequence/siNA sense region
accgggacgugcucaagga

SEQ ID NO: 674 - RNA, 19 nt, Artificial Sequence
  Description of Artificial Sequence: Target Sequence/siNA sense region
ggggcugugcaguggauga

SEQ ID NO: 675 - RNA, 19 nt, Artificial Sequence
  Description of Artificial Sequence: Target Sequence/siNA sense region
aagcuccaggacugcacga

SEQ ID NO: 676 - RNA, 19 nt, Artificial Sequence
  Description of Artificial Sequence: Target Sequence/siNA sense region
gcuccaggacugcacgaug

SEQ ID NO: 677 - RNA, 19 nt, Artificial Sequence
  Description of Artificial Sequence: Target Sequence/siNA sense region
uaccgggacgugcucaagg

SEQ ID NO: 678 - RNA, 19 nt, Artificial Sequence
  Description of Artificial Sequence: Target Sequence/siNA sense region
gggcugugcaguggaugaa

SEQ ID NO: 679 - RNA, 19 nt, Artificial Sequence
  Description of Artificial Sequence: Target Sequence/siNA sense region
cgucaaguucccgggcggu

SEQ ID NO: 680 - RNA, 19 nt, Artificial Sequence
  Description of Artificial Sequence: Target Sequence/siNA sense region
ucaauaggguggcuucaug

SEQ ID NO: 681 - RNA, 19 nt, Artificial Sequence
  Description of Artificial Sequence: Target Sequence/siNA sense region
agucuucacggaggcuaug

SEQ ID NO: 682 - RNA, 19 nt, Artificial Sequence
  Description of Artificial Sequence: Target Sequence/siNA sense region
ggaccaagcggagacggcu

SEQ ID NO: 683 - RNA, 19 nt, Artificial Sequence
  Description of Artificial Sequence: Target Sequence/siNA sense region
ggcuccaguccaagcuccu

SEQ ID NO: 684 - RNA, 19 nt, Artificial Sequence
  Description of Artificial Sequence: Target Sequence/siNA sense region
ggcugugcaguggaugaac

SEQ ID NO: 685 - RNA, 19 nt, Artificial Sequence
  Description of Artificial Sequence: Target Sequence/siNA sense region
cuccaggacugcacgaugc

SEQ ID NO: 686 - RNA, 19 nt, Artificial Sequence
  Description of Artificial Sequence: Target Sequence/siNA sense region
gagucuucacggaggcuau

SEQ ID NO: 687 - RNA, 19 nt, Artificial Sequence
  Description of Artificial Sequence: Target Sequence/siNA sense region
uggcuccaguccaagcucc

SEQ ID NO: 688 - RNA, 19 nt, Artificial Sequence
  Description of Artificial Sequence: Target Sequence/siNA sense region
ggggauuuccacuacguga

SEQ ID NO: 689 - RNA, 19 nt, Artificial Sequence
  Description of Artificial Sequence: Target Sequence/siNA sense region
caugccucaggaaacuugg

SEQ ID NO: 690 - RNA, 19 nt, Artificial Sequence
  Description of Artificial Sequence: Target Sequence/siNA sense region
aucaauaggguggcuucau

SEQ ID NO: 691 - RNA, 19 nt, Artificial Sequence
  Description of Artificial Sequence: Target Sequence/siNA sense region
gcgggccuugccuacuauu

SEQ ID NO: 692 - RNA, 19 nt, Artificial Sequence
  Description of Artificial Sequence: Target Sequence/siNA sense region
ccgggacgugcucaaggag

SEQ ID NO: 693 - RNA, 19 nt, Artificial Sequence
  Description of Artificial Sequence: Target Sequence/siNA sense region
ccaugguggggaacugggc

SEQ ID NO: 694 - RNA, 19 nt, Artificial Sequence
  Description of Artificial Sequence: Target Sequence/siNA sense region
caauaggguggcuucaugc

SEQ ID NO: 695 - RNA, 19 nt, Artificial Sequence
  Description of Artificial Sequence: Target Sequence/siNA sense region
agcuccaggacugcacgau

SEQ ID NO: 696 - RNA, 19 nt, Artificial Sequence
  Description of Artificial Sequence: Target Sequence/siNA sense region
cgggccuugccuacuauuc

SEQ ID NO: 697 - RNA, 19 nt, Artificial Sequence
  Description of Artificial Sequence: Target Sequence/siNA antisense region
cuacgagaccucccggggc

SEQ ID NO: 698 - RNA, 19 nt, Artificial Sequence
  Description of Artificial Sequence: Target Sequence/siNA antisense region
ccuaucaggcaguaccaca

SEQ ID NO: 699 - RNA, 19 nt, Artificial Sequence
  Description of Artificial Sequence: Target Sequence/siNA antisense region
cuaucaggcaguaccacaa

SEQ ID NO: 700 - RNA, 19 nt, Artificial Sequence
  Description of Artificial Sequence: Target Sequence/siNA antisense region
ucuacgagaccucccgggg

SEQ ID NO: 701 - RNA, 19 nt, Artificial Sequence
  Description of Artificial Sequence: Target Sequence/siNA antisense region
cccuaucaggcaguaccac

SEQ ID NO: 702 - RNA, 19 nt, Artificial Sequence
  Description of Artificial Sequence: Target Sequence/siNA antisense region
caagcacccuaucaggcag

SEQ ID NO: 703 - RNA, 19 nt, Artificial Sequence
  Description of Artificial Sequence: Target Sequence/siNA antisense region
aucaggcaguaccacaagg

SEQ ID NO: 704 - RNA, 19 nt, Artificial Sequence
  Description of Artificial Sequence: Target Sequence/siNA antisense region
guaccacaaggccuuucgc

SEQ ID NO: 705 - RNA, 19 nt, Artificial Sequence
  Description of Artificial Sequence: Target Sequence/siNA antisense region
agcacccuaucaggcagua

SEQ ID NO: 706 - RNA, 19 nt, Artificial Sequence
  Description of Artificial Sequence: Target Sequence/siNA antisense region
cacccuaucaggcaguacc

SEQ ID NO: 707 - RNA, 19 nt, Artificial Sequence
  Description of Artificial Sequence: Target Sequence/siNA antisense region
gcaguaccacaaggccuuu

SEQ ID NO: 708 - RNA, 19 nt, Artificial Sequence
  Description of Artificial Sequence: Target Sequence/siNA antisense region
ggcaguaccacaaggccuu

SEQ ID NO: 709 - RNA, 19 nt, Artificial Sequence
  Description of Artificial Sequence: Target Sequence/siNA antisense region
uaucaggcaguaccacaag

SEQ ID NO: 710 - RNA, 19 nt, Artificial Sequence
  Description of Artificial Sequence: Target Sequence/siNA antisense region
aggcaguaccacaaggccu

SEQ ID NO: 711 - RNA, 19 nt, Artificial Sequence
  Description of Artificial Sequence: Target Sequence/siNA antisense region
gcacccuaucaggcaguac

SEQ ID NO: 712 - RNA, 19 nt, Artificial Sequence
  Description of Artificial Sequence: Target Sequence/siNA antisense region
aagcacccuaucaggcagu

SEQ ID NO: 713 - RNA, 19 nt, Artificial Sequence
  Description of Artificial Sequence: Target Sequence/siNA antisense region
cucccggggcacucgcaag

SEQ ID NO: 714 - RNA, 19 nt, Artificial Sequence
  Description of Artificial Sequence: Target Sequence/siNA antisense region
cucgcaagcacccuaucag

SEQ ID NO: 715 - RNA, 19 nt, Artificial Sequence
  Description of Artificial Sequence: Target Sequence/siNA antisense region
ccucccggggcacucgcaa

SEQ ID NO: 716 - RNA, 19 nt, Artificial Sequence
  Description of Artificial Sequence: Target Sequence/siNA antisense region
ucgcaagcacccuaucagg

SEQ ID NO: 717 - RNA, 19 nt, Artificial Sequence
  Description of Artificial Sequence: Target Sequence/siNA antisense region
caggcaguaccacaaggcc

SEQ ID NO: 718 - RNA, 19 nt, Artificial Sequence
  Description of Artificial Sequence: Target Sequence/siNA antisense region
ucccggggcacucgcaagc

SEQ ID NO: 719 - RNA, 19 nt, Artificial Sequence
  Description of Artificial Sequence: Target Sequence/siNA antisense region
gcaagcacccuaucaggca

SEQ ID NO: 720 - RNA, 19 nt, Artificial Sequence
  Description of Artificial Sequence: Target Sequence/siNA antisense region
caguaccacaaggccuuuc

SEQ ID NO: 721 - RNA, 19 nt, Artificial Sequence
  Description of Artificial Sequence: Target Sequence/siNA antisense region
cgcaagcacccuaucaggc

SEQ ID NO: 722 - RNA, 19 nt, Artificial Sequence
  Description of Artificial Sequence: Target Sequence/siNA antisense region
aguaccacaaggccuuucg

SEQ ID NO: 723 - RNA, 19 nt, Artificial Sequence
  Description of Artificial Sequence: Target Sequence/siNA antisense region
ucaggcaguaccacaaggc

SEQ ID NO: 724 - RNA, 19 nt, Artificial Sequence
  Description of Artificial Sequence: Target Sequence/siNA antisense region
gagaccucccggggcacuc

SEQ ID NO: 725 - RNA, 19 nt, Artificial Sequence
  Description of Artificial Sequence: Target Sequence/siNA antisense region
gucuacgagaccucccggg

SEQ ID NO: 726 - RNA, 19 nt, Artificial Sequence
  Description of Artificial Sequence: Target Sequence/siNA antisense region
accucccggggcacucgca

SEQ ID NO: 727 - RNA, 19 nt, Artificial Sequence
  Description of Artificial Sequence: Target Sequence/siNA antisense region
acccuaucaggcaguacca

SEQ ID NO: 728 - RNA, 19 nt, Artificial Sequence
  Description of Artificial Sequence: Target Sequence/siNA antisense region
auuccgguguacucaccgg

SEQ ID NO: 729 - RNA, 19 nt, Artificial Sequence
  Description of Artificial Sequence: Target Sequence/siNA antisense region
gaccucccggggcacucgc

SEQ ID NO: 730 - RNA, 19 nt, Artificial Sequence
  Description of Artificial Sequence: Target Sequence/siNA antisense region
agaccucccggggcacucg

SEQ ID NO: 731 - RNA, 19 nt, Artificial Sequence
  Description of Artificial Sequence: Target Sequence/siNA antisense region
uacgagaccucccggggca

SEQ ID NO: 732 - RNA, 19 nt, Artificial Sequence
  Description of Artificial Sequence: Target Sequence/siNA antisense region
acgagaccucccggggcac

SEQ ID NO: 733 - RNA, 19 nt, Artificial Sequence
  Description of Artificial Sequence: Target Sequence/siNA antisense region
cgagaccucccggggcacu

SEQ ID NO: 734 - RNA, 19 nt, Artificial Sequence
  Description of Artificial Sequence: Target Sequence/siNA antisense region
ggucuacgagaccucccgg

SEQ ID NO: 735 - RNA, 19 nt, Artificial Sequence
  Description of Artificial Sequence: Target Sequence/siNA antisense region
acucgcaagcacccuauca

SEQ ID NO: 736 - RNA, 19 nt, Artificial Sequence
  Description of Artificial Sequence: Target Sequence/siNA antisense region
ccggggcacucgcaagcac

SEQ ID NO: 737 - RNA, 19 nt, Artificial Sequence
  Description of Artificial Sequence: Target Sequence/siNA antisense region
gcacucgcaagcacccuau

SEQ ID NO: 738 - RNA, 19 nt, Artificial Sequence
  Description of Artificial Sequence: Target Sequence/siNA antisense region
ggggcacucgcaagcaccc

SEQ ID NO: 739 - RNA, 19 nt, Artificial Sequence
  Description of Artificial Sequence: Target Sequence/siNA antisense region
cggucuacgagaccucccg

SEQ ID NO: 740 - RNA, 19 nt, Artificial Sequence
  Description of Artificial Sequence: Target Sequence/siNA antisense region
acggucuacgagaccuccc

SEQ ID NO: 741 - RNA, 19 nt, Artificial Sequence
  Description of Artificial Sequence: Target Sequence/siNA antisense region
cacucgcaagcacccuauc

SEQ ID NO: 742 - RNA, 19 nt, Artificial Sequence
  Description of Artificial Sequence: Target Sequence/siNA antisense region
cacggucuacgagaccucc

SEQ ID NO: 743 - RNA, 19 nt, Artificial Sequence
  Description of Artificial Sequence: Target Sequence/siNA antisense region
gggcacucgcaagcacccu

SEQ ID NO: 744 - RNA, 19 nt, Artificial Sequence
  Description of Artificial Sequence: Target Sequence/siNA antisense region
cccggggcacucgcaagca

SEQ ID NO: 745 - RNA, 19 nt, Artificial Sequence
  Description of Artificial Sequence: Target Sequence/siNA antisense region
cggggcacucgcaagcacc

SEQ ID NO: 746 - RNA, 19 nt, Artificial Sequence
  Description of Artificial Sequence: Target Sequence/siNA antisense region
ggcacucgcaagcacccua

SEQ ID NO: 747 - RNA, 19 nt, Artificial Sequence
  Description of Artificial Sequence: Target Sequence/siNA antisense region
ugcacggucuacgagaccu

SEQ ID NO: 748 - RNA, 19 nt, Artificial Sequence
  Description of Artificial Sequence: Target Sequence/siNA antisense region
gcacggucuacgagaccuc

SEQ ID NO: 749 - RNA, 19 nt, Artificial Sequence
  Description of Artificial Sequence: Target Sequence/siNA antisense region
cgguguacucaccgguucc

SEQ ID NO: 750 - RNA, 19 nt, Artificial Sequence
  Description of Artificial Sequence: Target Sequence/siNA antisense region
gguguacucaccgguuccg

SEQ ID NO: 751 - RNA, 19 nt, Artificial Sequence
  Description of Artificial Sequence: Target Sequence/siNA antisense region
aauuccgguguacucaccg

SEQ ID NO: 752 - RNA, 19 nt, Artificial Sequence
  Description of Artificial Sequence: Target Sequence/siNA antisense region
guguacucaccgguuccgc

SEQ ID NO: 753 - RNA, 19 nt, Artificial Sequence
  Description of Artificial Sequence: Target Sequence/siNA antisense region
uccgguguacucaccgguu

SEQ ID NO: 754 - RNA, 19 nt, Artificial Sequence
  Description of Artificial Sequence: Target Sequence/siNA antisense region
uuccgguguacucaccggu

SEQ ID NO: 755 - RNA, 19 nt, Artificial Sequence
  Description of Artificial Sequence: Target Sequence/siNA antisense region
guacucaccgguuccgcag

SEQ ID NO: 756 - RNA, 19 nt, Artificial Sequence
  Description of Artificial Sequence: Target Sequence/siNA antisense region
acucaccgguuccgcagac

SEQ ID NO: 757 - RNA, 19 nt, Artificial Sequence
  Description of Artificial Sequence: Target Sequence/siNA antisense region
ccgguguacucaccgguuc

SEQ ID NO: 758 - RNA, 19 nt, Artificial Sequence
  Description of Artificial Sequence: Target Sequence/siNA antisense region
uguacucaccgguuccgca

SEQ ID NO: 759 - RNA, 19 nt, Artificial Sequence
  Description of Artificial Sequence: Target Sequence/siNA antisense region
uacucaccgguuccgcaga

SEQ ID NO: 760 - RNA, 19 nt, Artificial Sequence
  Description of Artificial Sequence: Target Sequence/siNA antisense region
agaccacuauggcucuccc

SEQ ID NO: 761 - RNA, 19 nt, Artificial Sequence
  Description of Artificial Sequence: Target Sequence/siNA antisense region
caccgguuccgcagaccac

SEQ ID NO: 762 - RNA, 19 nt, Artificial Sequence
  Description of Artificial Sequence: Target Sequence/siNA antisense region
cucaccgguuccgcagacc

SEQ ID NO: 763 - RNA, 19 nt, Artificial Sequence
  Description of Artificial Sequence: Target Sequence/siNA antisense region
gaccacuauggcucucccg

SEQ ID NO: 764 - RNA, 19 nt, Artificial Sequence
  Description of Artificial Sequence: Target Sequence/siNA antisense region
accacuauggcucucccgg

SEQ ID NO: 765 - RNA, 19 nt, Artificial Sequence
  Description of Artificial Sequence: Target Sequence/siNA antisense region
ucaccgguuccgcagacca

SEQ ID NO: 766 - RNA, 19 nt, Artificial Sequence
  Description of Artificial Sequence: Target Sequence/siNA antisense region
gcaauuccgguguacucac

SEQ ID NO: 767 - RNA, 19 nt, Artificial Sequence
  Description of Artificial Sequence: Target Sequence/siNA antisense region
ggcaauuccgguguacuca

SEQ ID NO: 768 - RNA, 19 nt, Artificial Sequence
  Description of Artificial Sequence: Target Sequence/siNA antisense region
caauuccgguguacucacc

SEQ ID NO: 769 - RNA, 19 nt, Artificial Sequence
  Description of Artificial Sequence: Target Sequence/siNA antisense region
ccgcagaccacuauggcuc

SEQ ID NO: 770 - RNA, 19 nt, Artificial Sequence
  Description of Artificial Sequence: Target Sequence/siNA antisense region
cgcagaccacuauggcucu

SEQ ID NO: 771 - RNA, 19 nt, Artificial Sequence
  Description of Artificial Sequence: Target Sequence/siNA antisense region
ccgguuccgcagaccacua

SEQ ID NO: 772 - RNA, 19 nt, Artificial Sequence
  Description of Artificial Sequence: Target Sequence/siNA antisense region
cgguuccgcagaccacuau

SEQ ID NO: 773 - RNA, 19 nt, Artificial Sequence
  Description of Artificial Sequence: Target Sequence/siNA antisense region
gcagaccacuauggcucuc

SEQ ID NO: 774 - RNA, 19 nt, Artificial Sequence
  Description of Artificial Sequence: Target Sequence/siNA antisense region
uuccgcagaccacuauggc

SEQ ID NO: 775 - RNA, 19 nt, Artificial Sequence
  Description of Artificial Sequence: Target Sequence/siNA antisense region
accgguuccgcagaccacu

SEQ ID NO: 776 - RNA, 19 nt, Artificial Sequence
  Description of Artificial Sequence: Target Sequence/siNA antisense region
gguuccgcagaccacuaug

SEQ ID NO: 777 - RNA, 19 nt, Artificial Sequence
  Description of Artificial Sequence: Target Sequence/siNA antisense region
uccgcagaccacuauggcu

SEQ ID NO: 778 - RNA, 19 nt, Artificial Sequence
  Description of Artificial Sequence: Target Sequence/siNA antisense region
guuccgcagaccacuaugg

SEQ ID NO: 779 - RNA, 19 nt, Artificial Sequence
  Description of Artificial Sequence: Target Sequence/siNA antisense region
auggcucucccgggagggg

SEQ ID NO: 780 - RNA, 19 nt, Artificial Sequence
  Description of Artificial Sequence: Target Sequence/siNA antisense region
cagaccacuauggcucucc

SEQ ID NO: 781 - RNA, 19 nt, Artificial Sequence
  Description of Artificial Sequence: Target Sequence/siNA antisense region
ccacuauggcucucccggg

SEQ ID NO: 782 - RNA, 19 nt, Artificial Sequence
  Description of Artificial Sequence: Target Sequence/siNA antisense region
uggcucucccgggaggggg

SEQ ID NO: 783 - RNA, 19 nt, Artificial Sequence
  Description of Artificial Sequence: Target Sequence/siNA antisense region
cacuauggcucucccggga

SEQ ID NO: 784 - RNA, 19 nt, Artificial Sequence
  Description of Artificial Sequence: Target Sequence/siNA antisense region
ggcucucccgggagggggg

SEQ ID NO: 785 - RNA, 19 nt, Artificial Sequence
  Description of Artificial Sequence: Target Sequence/siNA antisense region
uauggcucucccgggaggg

SEQ ID NO: 786 - RNA, 19 nt, Artificial Sequence
  Description of Artificial Sequence: Target Sequence/siNA antisense region
cuauggcucucccgggagg

SEQ ID NO: 787 - RNA, 19 nt, Artificial Sequence
  Description of Artificial Sequence: Target Sequence/siNA antisense region
acuauggcucucccgggag

SEQ ID NO: 788 - RNA, 19 nt, Artificial Sequence
  Description of Artificial Sequence: Target Sequence/siNA antisense region
gggccccugcgcggcaaca

SEQ ID NO: 789 - RNA, 19 nt, Artificial Sequence
  Description of Artificial Sequence: Target Sequence/siNA antisense region
gcucucccgggaggggggg

SEQ ID NO: 790 - RNA, 19 nt, Artificial Sequence
  Description of Artificial Sequence: Target Sequence/siNA antisense region
cacucauacuaacgccaug

SEQ ID NO: 791 - RNA, 19 nt, Artificial Sequence
  Description of Artificial Sequence: Target Sequence/siNA antisense region
cauacuaacgccauggcua

SEQ ID NO: 792 - RNA, 19 nt, Artificial Sequence
  Description of Artificial Sequence: Target Sequence/siNA antisense region
ucauacuaacgccauggcu

SEQ ID NO: 793 - RNA, 19 nt, Artificial Sequence
  Description of Artificial Sequence: Target Sequence/siNA antisense region
acucauacuaacgccaugg

SEQ ID NO: 794 - RNA, 19 nt, Artificial Sequence
  Description of Artificial Sequence: Target Sequence/siNA antisense region
acacucauacuaacgccau

SEQ ID NO: 795 - RNA, 19 nt, Artificial Sequence
  Description of Artificial Sequence: Target Sequence/siNA antisense region
acgccauggcuagacgcuu

SEQ ID NO: 796 - RNA, 19 nt, Artificial Sequence
  Description of Artificial Sequence: Target Sequence/siNA antisense region
acuaacgccauggcuagac

SEQ ID NO: 797 - RNA, 19 nt, Artificial Sequence
  Description of Artificial Sequence: Target Sequence/siNA antisense region
cgccauggcuagacgcuuu

SEQ ID NO: 798 - RNA, 19 nt, Artificial Sequence
  Description of Artificial Sequence: Target Sequence/siNA antisense region
uaacgccauggcuagacgc

SEQ ID NO: 799 - RNA, 19 nt, Artificial Sequence
  Description of Artificial Sequence: Target Sequence/siNA antisense region
cucauacuaacgccauggc

SEQ ID NO: 800 - RNA, 19 nt, Artificial Sequence
  Description of Artificial Sequence: Target Sequence/siNA antisense region
aacgccauggcuagacgcu

SEQ ID NO: 801 - RNA, 19 nt, Artificial Sequence
  Description of Artificial Sequence: Target Sequence/siNA antisense region
cuaacgccauggcuagacg

SEQ ID NO: 802 - RNA, 19 nt, Artificial Sequence
  Description of Artificial Sequence: Target Sequence/siNA antisense region
uacuaacgccauggcuaga

SEQ ID NO: 803 - RNA, 19 nt, Artificial Sequence
  Description of Artificial Sequence: Target Sequence/siNA antisense region
gccauggcuagacgcuuuc

SEQ ID NO: 804 - RNA, 19 nt, Artificial Sequence
  Description of Artificial Sequence: Target Sequence/siNA antisense region
auacuaacgccauggcuag

SEQ ID NO: 805 - RNA, 19 nt, Artificial Sequence
  Description of Artificial Sequence: Target Sequence/siNA antisense region
aguuccucacaggggagug

SEQ ID NO: 806 - RNA, 19 nt, Artificial Sequence
  Description of Artificial Sequence: Target Sequence/siNA antisense region
uuugguuuuucuuugaggu

SEQ ID NO: 807 - RNA, 19 nt, Artificial Sequence
  Description of Artificial Sequence: Target Sequence/siNA antisense region
uggcuagacgcuuucugcg

SEQ ID NO: 808 - RNA, 19 nt, Artificial Sequence
  Description of Artificial Sequence: Target Sequence/siNA antisense region
gguaucgaugaccuuaccc

SEQ ID NO: 809 - RNA, 19 nt, Artificial Sequence
  Description of Artificial Sequence: Target Sequence/siNA antisense region
cauggcuagacgcuuucug

SEQ ID NO: 810 - RNA, 19 nt, Artificial Sequence
  Description of Artificial Sequence: Target Sequence/siNA antisense region
ugguuuuucuuugagguuu

SEQ ID NO: 811 - RNA, 19 nt, Artificial Sequence
  Description of Artificial Sequence: Target Sequence/siNA antisense region
auggcuagacgcuuucugc

SEQ ID NO: 812 - RNA, 19 nt, Artificial Sequence
  Description of Artificial Sequence: Target Sequence/siNA antisense region
ccauggcuagacgcuuucu

SEQ ID NO: 813 - RNA, 19 nt, Artificial Sequence
  Description of Artificial Sequence: Target Sequence/siNA antisense region
ggcuagacgcuuucugcgu

SEQ ID NO: 814 - RNA, 19 nt, Artificial Sequence
  Description of Artificial Sequence: Target Sequence/siNA antisense region
uugguuuuucuuugagguu

SEQ ID NO: 815 - RNA, 19 nt, Artificial Sequence
  Description of Artificial Sequence: Target Sequence/siNA antisense region
guaucgaugaccuuaccca

SEQ ID NO: 816 - RNA, 19 nt, Artificial Sequence
  Description of Artificial Sequence: Target Sequence/siNA antisense region
aggguaucgaugaccuuac

SEQ ID NO: 817 - RNA, 19 nt, Artificial Sequence
  Description of Artificial Sequence: Target Sequence/siNA antisense region
uagacgcuuucugcgugaa

SEQ ID NO: 818 - RNA, 19 nt, Artificial Sequence
  Description of Artificial Sequence: Target Sequence/siNA antisense region
ggguaucgaugaccuuacc

SEQ ID NO: 819 - RNA, 19 nt, Artificial Sequence
  Description of Artificial Sequence: Target Sequence/siNA antisense region
uuccucacaggggagugau

SEQ ID NO: 820 - RNA, 19 nt, Artificial Sequence
  Description of Artificial Sequence: Target Sequence/siNA antisense region
guuccucacaggggaguga

SEQ ID NO: 821 - RNA, 19 nt, Artificial Sequence
  Description of Artificial Sequence: Target Sequence/siNA antisense region
cgcuuucugcgugaagaca

SEQ ID NO: 822 - RNA, 19 nt, Artificial Sequence
  Description of Artificial Sequence: Target Sequence/siNA antisense region
cuagacgcuuucugcguga

SEQ ID NO: 823 - RNA, 19 nt, Artificial Sequence
  Description of Artificial Sequence: Target Sequence/siNA antisense region
gcuagacgcuuucugcgug

SEQ ID NO: 824 - RNA, 19 nt, Artificial Sequence
  Description of Artificial Sequence: Target Sequence/siNA antisense region
uccaagaaaggacccgguc

SEQ ID NO: 825 - RNA, 19 nt, Artificial Sequence
  Description of Artificial Sequence: Target Sequence/siNA antisense region
gugaagacaguaguuccuc

SEQ ID NO: 826 - RNA, 19 nt, Artificial Sequence
  Description of Artificial Sequence: Target Sequence/siNA antisense region
agacaguaguuccucacag

SEQ ID NO: 827 - RNA, 19 nt, Artificial Sequence
  Description of Artificial Sequence: Target Sequence/siNA antisense region
gcgugaagacaguaguucc

SEQ ID NO: 828 - RNA, 19 nt, Artificial Sequence
  Description of Artificial Sequence: Target Sequence/siNA antisense region
uaguuccucacaggggagu

SEQ ID NO: 829 - RNA, 19 nt, Artificial Sequence
  Description of Artificial Sequence: Target Sequence/siNA antisense region
acgcuuucugcgugaagac

SEQ ID NO: 830 - RNA, 19 nt, Artificial Sequence
  Description of Artificial Sequence: Target Sequence/siNA antisense region
cgugaagacaguaguuccu

SEQ ID NO: 831 - RNA, 19 nt, Artificial Sequence
  Description of Artificial Sequence: Target Sequence/siNA antisense region
gacaguaguuccucacagg

SEQ ID NO: 832 - RNA, 19 nt, Artificial Sequence
  Description of Artificial Sequence: Target Sequence/siNA antisense region
aagacaguaguuccucaca

SEQ ID NO: 833 - RNA, 19 nt, Artificial Sequence
  Description of Artificial Sequence: Target Sequence/siNA antisense region
gacgcuuucugcgugaaga

SEQ ID NO: 834 - RNA, 19 nt, Artificial Sequence
  Description of Artificial Sequence: Target Sequence/siNA antisense region
ugcgugaagacaguaguuc

SEQ ID NO: 835 - RNA, 19 nt, Artificial Sequence
  Description of Artificial Sequence: Target Sequence/siNA antisense region
acaguaguuccucacaggg

SEQ ID NO: 836 - RNA, 19 nt, Artificial Sequence
  Description of Artificial Sequence: Target Sequence/siNA antisense region
agacgcuuucugcgugaag

SEQ ID NO: 837 - RNA, 19 nt, Artificial Sequence
  Description of Artificial Sequence: Target Sequence/siNA antisense region
ugaagacaguaguuccuca

SEQ ID NO: 838 - RNA, 19 nt, Artificial Sequence
  Description of Artificial Sequence: Target Sequence/siNA antisense region
gacacucauacuaacgcca

SEQ ID NO: 839 - RNA, 19 nt, Artificial Sequence
  Description of Artificial Sequence: Target Sequence/siNA antisense region
caguaguuccucacagggg

SEQ ID NO: 840 - RNA, 19 nt, Artificial Sequence
  Description of Artificial Sequence: Target Sequence/siNA antisense region
gaagacaguaguuccucac

SEQ ID NO: 841 - RNA, 19 nt, Artificial Sequence
  Description of Artificial Sequence: Target Sequence/siNA antisense region
cgacacucauacuaacgcc

SEQ ID NO: 842 - RNA, 19 nt, Artificial Sequence
  Description of Artificial Sequence: Target Sequence/siNA antisense region
cgacccaacacuacucggc

SEQ ID NO: 843 - RNA, 19 nt, Artificial Sequence
  Description of Artificial Sequence: Target Sequence/siNA antisense region
cuuucugcgugaagacagu

SEQ ID NO: 844 - RNA, 19 nt, Artificial Sequence
  Description of Artificial Sequence: Target Sequence/siNA antisense region
caaggccuuucgcgaccca

SEQ ID NO: 845 - RNA, 19 nt, Artificial Sequence
  Description of Artificial Sequence: Target Sequence/siNA antisense region
uucugcgugaagacaguag

SEQ ID NO: 846 - RNA, 19 nt, Artificial Sequence
  Description of Artificial Sequence: Target Sequence/siNA antisense region
cgcgacccaacacuacucg

SEQ ID NO: 847 - RNA, 19 nt, Artificial Sequence
  Description of Artificial Sequence: Target Sequence/siNA antisense region
uuucgcgacccaacacuac

SEQ ID NO: 848 - RNA, 19 nt, Artificial Sequence
  Description of Artificial Sequence: Target Sequence/siNA antisense region
gguuuuucuuugagguuua

SEQ ID NO: 849 - RNA, 19 nt, Artificial Sequence
  Description of Artificial Sequence: Target Sequence/siNA antisense region
gcgacccaacacuacucgg

SEQ ID NO: 850 - RNA, 19 nt, Artificial Sequence
  Description of Artificial Sequence: Target Sequence/siNA antisense region
gacccaacacuacucggcu

SEQ ID NO: 851 - RNA, 19 nt, Artificial Sequence
  Description of Artificial Sequence: Target Sequence/siNA antisense region
ccacaaggccuuucgcgac

SEQ ID NO: 852 - RNA, 19 nt, Artificial Sequence
  Description of Artificial Sequence: Target Sequence/siNA antisense region
cuuucgcgacccaacacua

SEQ ID NO: 853 - RNA, 19 nt, Artificial Sequence
  Description of Artificial Sequence: Target Sequence/siNA antisense region
cccaacacuacucggcuag

SEQ ID NO: 854 - RNA, 19 nt, Artificial Sequence
  Description of Artificial Sequence: Target Sequence/siNA antisense region
ucgcgacccaacacuacuc

SEQ ID NO: 855 - RNA, 19 nt, Artificial Sequence
  Description of Artificial Sequence: Target Sequence/siNA antisense region
accacaaggccuuucgcga

SEQ ID NO: 856 - RNA, 19 nt, Artificial Sequence
  Description of Artificial Sequence: Target Sequence/siNA antisense region
acgacacucauacuaacgc

SEQ ID NO: 857 - RNA, 19 nt, Artificial Sequence
  Description of Artificial Sequence: Target Sequence/siNA antisense region
acccaacacuacucggcua

SEQ ID NO: 858 - RNA, 19 nt, Artificial Sequence
  Description of Artificial Sequence: Target Sequence/siNA antisense region
cugcgugaagacaguaguu

SEQ ID NO: 859 - RNA, 19 nt, Artificial Sequence
  Description of Artificial Sequence: Target Sequence/siNA antisense region
uaccacaaggccuuucgcg

SEQ ID NO: 860 - RNA, 19 nt, Artificial Sequence
  Description of Artificial Sequence: Target Sequence/siNA antisense region
ccuuucgcgacccaacacu

SEQ ID NO: 861 - RNA, 19 nt, Artificial Sequence
  Description of Artificial Sequence: Target Sequence/siNA antisense region
aggccuuucgcgacccaac

SEQ ID NO: 862 - RNA, 19 nt, Artificial Sequence
  Description of Artificial Sequence: Target Sequence/siNA antisense region
uucgcgacccaacacuacu

SEQ ID NO: 863 - RNA, 19 nt, Artificial Sequence
  Description of Artificial Sequence: Target Sequence/siNA antisense region
aaggccuuucgcgacccaa

SEQ ID NO: 864 - RNA, 19 nt, Artificial Sequence
  Description of Artificial Sequence: Target Sequence/siNA antisense region
aguaguuccucacagggga

SEQ ID NO: 865 - RNA, 19 nt, Artificial Sequence
  Description of Artificial Sequence: Target Sequence/siNA antisense region
uuucugcgugaagacagua

SEQ ID NO: 866 - RNA, 19 nt, Artificial Sequence
  Description of Artificial Sequence: Target Sequence/siNA antisense region
gccuuucgcgacccaacac

SEQ ID NO: 867 - RNA, 19 nt, Artificial Sequence
  Description of Artificial Sequence: Target Sequence/siNA antisense region
ucugcgugaagacaguagu

SEQ ID NO: 868 - RNA, 19 nt, Artificial Sequence
  Description of Artificial Sequence: Target Sequence/siNA antisense region
gcuuucugcgugaagacag

SEQ ID NO: 869 - RNA, 19 nt, Artificial Sequence
  Description of Artificial Sequence: Target Sequence/siNA antisense region
acaaggccuuucgcgaccc

SEQ ID NO: 870 - RNA, 19 nt, Artificial Sequence
  Description of Artificial Sequence: Target Sequence/siNA antisense region
uuuuucuuugagguuuagg

SEQ ID NO: 871 - RNA, 19 nt, Artificial Sequence
  Description of Artificial Sequence: Target Sequence/siNA antisense region
cacaaggccuuucgcgacc

SEQ ID NO: 872 - RNA, 19 nt, Artificial Sequence
  Description of Artificial Sequence: Target Sequence/siNA antisense region
guuuuucuuugagguuuag

SEQ ID NO: 873 - RNA, 19 nt, Artificial Sequence
  Description of Artificial Sequence: Target Sequence/siNA antisense region
ggccuuucgcgacccaaca

SEQ ID NO: 874 - RNA, 19 nt, Artificial Sequence
  Description of Artificial Sequence: Target Sequence/siNA antisense region
guaguuccucacaggggag

SEQ ID NO: 875 - RNA, 19 nt, Artificial Sequence
  Description of Artificial Sequence: Target Sequence/siNA antisense region
uuuucuuugagguuuagga

SEQ ID NO: 876 - RNA, 19 nt, Artificial Sequence
  Description of Artificial Sequence: Target Sequence/siNA antisense region
auccaagaaaggacccggu

SEQ ID NO: 877 - RNA, 19 nt, Artificial Sequence
  Description of Artificial Sequence: Target Sequence/siNA antisense region
uucuuugagguuuaggauu

SEQ ID NO: 878 - RNA, 19 nt, Artificial Sequence
  Description of Artificial Sequence: Target Sequence/siNA antisense region
ccaaaucuccaggcauuga

SEQ ID NO: 879 - RNA, 19 nt, Artificial Sequence
  Description of Artificial Sequence: Target Sequence/siNA antisense region
cgcccaaaucuccaggcau

SEQ ID NO: 880 - RNA, 19 nt, Artificial Sequence
  Description of Artificial Sequence: Target Sequence/siNA antisense region
gcccaaaucuccaggcauu

SEQ ID NO: 881 - RNA, 19 nt, Artificial Sequence
  Description of Artificial Sequence: Target Sequence/siNA antisense region
auguaccccaugaggucgg

SEQ ID NO: 882 - RNA, 19 nt, Artificial Sequence
  Description of Artificial Sequence: Target Sequence/siNA antisense region
aaaucuccaggcauugagc

SEQ ID NO: 883 - RNA, 19 nt, Artificial Sequence
  Description of Artificial Sequence: Target Sequence/siNA antisense region
caaaucuccaggcauugag

SEQ ID NO: 884 - RNA, 19 nt, Artificial Sequence
  Description of Artificial Sequence: Target Sequence/siNA antisense region
ccaacacuacucggcuagc

SEQ ID NO: 885 - RNA, 19 nt, Artificial Sequence
  Description of Artificial Sequence: Target Sequence/siNA antisense region
aaucuccaggcauugagcg

SEQ ID NO: 886 - RNA, 19 nt, Artificial Sequence
  Description of Artificial Sequence: Target Sequence/siNA antisense region
cccaaaucuccaggcauug

SEQ ID NO: 887 - RNA, 19 nt, Artificial Sequence
  Description of Artificial Sequence: Target Sequence/siNA antisense region
uguaccccaugaggucggc

SEQ ID NO: 888 - RNA, 19 nt, Artificial Sequence
  Description of Artificial Sequence: Target Sequence/siNA antisense region
uuucuuugagguuuaggau

SEQ ID NO: 889 - RNA, 19 nt, Artificial Sequence
  Description of Artificial Sequence: Target Sequence/siNA antisense region
cgggggcacgcccaaaucu

SEQ ID NO: 890 - RNA, 19 nt, Artificial Sequence
  Description of Artificial Sequence: Target Sequence/siNA antisense region
ucuccaggcauugagcggg

SEQ ID NO: 891 - RNA, 19 nt, Artificial Sequence
  Description of Artificial Sequence: Target Sequence/siNA antisense region
gggggcacgcccaaaucuc

SEQ ID NO: 892 - RNA, 19 nt, Artificial Sequence
  Description of Artificial Sequence: Target Sequence/siNA antisense region
ggggcacgcccaaaucucc

SEQ ID NO: 893 - RNA, 19 nt, Artificial Sequence
  Description of Artificial Sequence: Target Sequence/siNA antisense region
gcgggggcacgcccaaauc

SEQ ID NO: 894 - RNA, 19 nt, Artificial Sequence
  Description of Artificial Sequence: Target Sequence/siNA antisense region
aucuccaggcauugagcgg

SEQ ID NO: 895 - RNA, 19 nt, Artificial Sequence
  Description of Artificial Sequence: Target Sequence/siNA antisense region
cuggcaauuccgguguacu

SEQ ID NO: 896 - RNA, 19 nt, Artificial Sequence
  Description of Artificial Sequence: Target Sequence/siNA antisense region
uccuggcaauuccggugua

SEQ ID NO: 897 - RNA, 19 nt, Artificial Sequence
  Description of Artificial Sequence: Target Sequence/siNA antisense region
uggcaauuccgguguacuc

SEQ ID NO: 898 - RNA, 19 nt, Artificial Sequence
  Description of Artificial Sequence: Target Sequence/siNA antisense region
ccuggcaauuccgguguac

SEQ ID NO: 899 - RNA, 19 nt, Artificial Sequence
  Description of Artificial Sequence: Target Sequence/siNA antisense region
uggggccccugcgcggcaa

SEQ ID NO: 900 - RNA, 19 nt, Artificial Sequence
  Description of Artificial Sequence: Target Sequence/siNA antisense region
ggcacgcccaaaucuccag

SEQ ID NO: 901 - RNA, 19 nt, Artificial Sequence
  Description of Artificial Sequence: Target Sequence/siNA antisense region
ggggccccugcgcggcaac

SEQ ID NO: 902 - RNA, 19 nt, Artificial Sequence
  Description of Artificial Sequence: Target Sequence/siNA antisense region
cacgcccaaaucuccaggc

SEQ ID NO: 903 - RNA, 19 nt, Artificial Sequence
  Description of Artificial Sequence: Target Sequence/siNA antisense region
gggcacgcccaaaucucca

SEQ ID NO: 904 - RNA, 19 nt, Artificial Sequence
  Description of Artificial Sequence: Target Sequence/siNA antisense region
gcacgcccaaaucuccagg

SEQ ID NO: 905 - RNA, 19 nt, Artificial Sequence
  Description of Artificial Sequence: Target Sequence/siNA antisense region
caacacuacucggcuagca

SEQ ID NO: 906 - RNA, 19 nt, Artificial Sequence
  Description of Artificial Sequence: Target Sequence/siNA antisense region
acgcccaaaucuccaggca

SEQ ID NO: 907 - RNA, 19 nt, Artificial Sequence
  Description of Artificial Sequence: Target Sequence/siNA antisense region
aacacuacucggcuagcag

SEQ ID NO: 908 - RNA, 19 nt, Artificial Sequence
  Description of Artificial Sequence: Target Sequence/siNA antisense region
acacuacucggcuagcagu

SEQ ID NO: 909 - RNA, 19 nt, Artificial Sequence
  Description of Artificial Sequence: Target Sequence/siNA antisense region
cacuacucggcuagcaguc

SEQ ID NO: 910 - RNA, 19 nt, Artificial Sequence
  Description of Artificial Sequence: Target Sequence/siNA antisense region
acuacucggcuagcagucu

SEQ ID NO: 911 - RNA, 19 nt, Artificial Sequence
  Description of Artificial Sequence: Target Sequence/siNA antisense region
cuccaggcauugagcgggu

SEQ ID NO: 912 - RNA, 19 nt, Artificial Sequence
  Description of Artificial Sequence: Target Sequence/siNA antisense region
uccaggcauugagcggguu

SEQ ID NO: 913 - RNA, 19 nt, Artificial Sequence
  Description of Artificial Sequence: Target Sequence/siNA antisense region
cuggggccccugcgcggca

SEQ ID NO: 914 - RNA, 19 nt, Artificial Sequence
  Description of Artificial Sequence: Target Sequence/siNA antisense region
cacccaaccuggggccccu

SEQ ID NO: 915 - RNA, 19 nt, Artificial Sequence
  Description of Artificial Sequence: Target Sequence/siNA antisense region
cacacccaaccuggggccc

SEQ ID NO: 916 - RNA, 19 nt, Artificial Sequence
  Description of Artificial Sequence: Target Sequence/siNA antisense region
acccaaccuggggccccug

SEQ ID NO: 917 - RNA, 19 nt, Artificial Sequence
  Description of Artificial Sequence: Target Sequence/siNA antisense region
gcacacccaaccuggggcc

SEQ ID NO: 918 - RNA, 19 nt, Artificial Sequence
  Description of Artificial Sequence: Target Sequence/siNA antisense region
ccaaccuggggccccugcg

SEQ ID NO: 919 - RNA, 19 nt, Artificial Sequence
  Description of Artificial Sequence: Target Sequence/siNA antisense region
acaggagccauccugccca

SEQ ID NO: 920 - RNA, 19 nt, Artificial Sequence
  Description of Artificial Sequence: Target Sequence/siNA antisense region
cgcacacccaaccuggggc

SEQ ID NO: 921 - RNA, 19 nt, Artificial Sequence
  Description of Artificial Sequence: Target Sequence/siNA antisense region
cccaaccuggggccccugc

SEQ ID NO: 922 - RNA, 19 nt, Artificial Sequence
  Description of Artificial Sequence: Target Sequence/siNA antisense region
gacaggagccauccugccc

SEQ ID NO: 923 - RNA, 19 nt, Artificial Sequence
  Description of Artificial Sequence: Target Sequence/siNA antisense region
acacccaaccuggggcccc

SEQ ID NO: 924 - RNA, 19 nt, Artificial Sequence
  Description of Artificial Sequence: Target Sequence/siNA antisense region
ccuggggccccugcgcggc

SEQ ID NO: 925 - RNA, 19 nt, Artificial Sequence
  Description of Artificial Sequence: Target Sequence/siNA antisense region
caaccuggggccccugcgc

SEQ ID NO: 926 - RNA, 19 nt, Artificial Sequence
  Description of Artificial Sequence: Target Sequence/siNA antisense region
aaccuggggccccugcgcg

SEQ ID NO: 927 - RNA, 19 nt, Artificial Sequence
  Description of Artificial Sequence: Target Sequence/siNA antisense region
accuggggccccugcgcgg

SEQ ID NO: 928 - RNA, 19 nt, Artificial Sequence
  Description of Artificial Sequence: Target Sequence/siNA antisense region
gaaaggacccggucguccu

SEQ ID NO: 929 - RNA, 19 nt, Artificial Sequence
  Description of Artificial Sequence: Target Sequence/siNA antisense region
aaaggacccggucguccug

SEQ ID NO: 930 - RNA, 19 nt, Artificial Sequence
  Description of Artificial Sequence: Target Sequence/siNA antisense region
ggacccggucguccuggca

SEQ ID NO: 931 - RNA, 19 nt, Artificial Sequence
  Description of Artificial Sequence: Target Sequence/siNA antisense region
acccggucguccuggcaau

SEQ ID NO: 932 - RNA, 19 nt, Artificial Sequence
  Description of Artificial Sequence: Target Sequence/siNA antisense region
cccggucguccuggcaauu

SEQ ID NO: 933 - RNA, 19 nt, Artificial Sequence
  Description of Artificial Sequence: Target Sequence/siNA antisense region
gacccggucguccuggcaa

SEQ ID NO: 934 - RNA, 19 nt, Artificial Sequence
  Description of Artificial Sequence: Target Sequence/siNA antisense region
aaggacccggucguccugg

SEQ ID NO: 935 - RNA, 19 nt, Artificial Sequence
  Description of Artificial Sequence: Target Sequence/siNA antisense region
aggacccggucguccuggc

SEQ ID NO: 936 - RNA, 19 nt, Artificial Sequence
  Description of Artificial Sequence: Target Sequence/siNA antisense region
ccggucguccuggcaauuc

SEQ ID NO: 937 - RNA, 19 nt, Artificial Sequence
  Description of Artificial Sequence: Target Sequence/siNA antisense region
caagaaaggacccggucgu

SEQ ID NO: 938 - RNA, 19 nt, Artificial Sequence
  Description of Artificial Sequence: Target Sequence/siNA antisense region
aagaaaggacccggucguc

SEQ ID NO: 939 - RNA, 19 nt, Artificial Sequence
  Description of Artificial Sequence: Target Sequence/siNA antisense region
ccaagaaaggacccggucg

SEQ ID NO: 940 - RNA, 19 nt, Artificial Sequence
  Description of Artificial Sequence: Target Sequence/siNA antisense region
agaaaggacccggucgucc

SEQ ID NO: 941 - RNA, 19 nt, Artificial Sequence
  Description of Artificial Sequence: Target Sequence/siNA antisense region
gucguccuggcaauuccgg

SEQ ID NO: 942 - RNA, 19 nt, Artificial Sequence
  Description of Artificial Sequence: Target Sequence/siNA antisense region
guccuggcaauuccggugu

SEQ ID NO: 943 - RNA, 19 nt, Artificial Sequence
  Description of Artificial Sequence: Target Sequence/siNA antisense region
ucguccuggcaauuccggu

SEQ ID NO: 944 - RNA, 19 nt, Artificial Sequence
  Description of Artificial Sequence: Target Sequence/siNA antisense region
ggucguccuggcaauuccg

SEQ ID NO: 945 - RNA, 19 nt, Artificial Sequence
  Description of Artificial Sequence: Target Sequence/siNA antisense region
cggucguccuggcaauucc

SEQ ID NO: 946 - RNA, 19 nt, Artificial Sequence
  Description of Artificial Sequence: Target Sequence/siNA antisense region
cguccuggcaauuccggug

SEQ ID NO: 947 - RNA, 19 nt, Artificial Sequence
  Description of Artificial Sequence: Target Sequence/siNA antisense region
gcgcacacccaaccugggg

SEQ ID NO: 948 - RNA, 19 nt, Artificial Sequence
  Description of Artificial Sequence: Target Sequence/siNA antisense region
guaaacuccaccaacgauc

SEQ ID NO: 949 - RNA, 19 nt, Artificial Sequence
  Description of Artificial Sequence: Target Sequence/siNA antisense region
aaacuccaccaacgaucug

SEQ ID NO: 950 - RNA, 19 nt, Artificial Sequence
  Description of Artificial Sequence: Target Sequence/siNA antisense region
uaaacuccaccaacgaucu

SEQ ID NO: 951 - RNA, 19 nt, Artificial Sequence
  Description of Artificial Sequence: Target Sequence/siNA antisense region
cgcgcacacccaaccuggg

SEQ ID NO: 952 - RNA, 19 nt, Artificial Sequence
  Description of Artificial Sequence: Target Sequence/siNA antisense region
gcgcgcacacccaaccugg

SEQ ID NO: 953 - RNA, 19 nt, Artificial Sequence
  Description of Artificial Sequence: Target Sequence/siNA antisense region
ucgcgcgcacacccaaccu

SEQ ID NO: 954 - RNA, 19 nt, Artificial Sequence
  Description of Artificial Sequence: Target Sequence/siNA antisense region
cgcgcgcacacccaaccug

SEQ ID NO: 955 - RNA, 19 nt, Artificial Sequence
  Description of Artificial Sequence: Target Sequence/siNA antisense region
gucgcgcgcacacccaacc

SEQ ID NO: 956 - RNA, 19 nt, Artificial Sequence
  Description of Artificial Sequence: Target Sequence/siNA antisense region
guguuacguuugguuuuuc

SEQ ID NO: 957 - RNA, 19 nt, Artificial Sequence
  Description of Artificial Sequence: Target Sequence/siNA antisense region
uguuacguuugguuuuucu

SEQ ID NO: 958 - RNA, 19 nt, Artificial Sequence
  Description of Artificial Sequence: Target Sequence/siNA antisense region
guugguguuacguuugguu

SEQ ID NO: 959 - RNA, 19 nt, Artificial Sequence
  Description of Artificial Sequence: Target Sequence/siNA antisense region
uuacguuugguuuuucuuu

SEQ ID NO: 960 - RNA, 19 nt, Artificial Sequence
  Description of Artificial Sequence: Target Sequence/siNA antisense region
gguguuacguuugguuuuu

SEQ ID NO: 961 - RNA, 19 nt, Artificial Sequence
  Description of Artificial Sequence: Target Sequence/siNA antisense region
guuacguuugguuuuucuu

SEQ ID NO: 962 - RNA, 19 nt, Artificial Sequence
  Description of Artificial Sequence: Target Sequence/siNA antisense region
uacguuugguuuuucuuug

SEQ ID NO: 963 - RNA, 19 nt, Artificial Sequence
  Description of Artificial Sequence: Target Sequence/siNA antisense region
cgcgaccuacgccgggggu

SEQ ID NO: 964 - RNA, 19 nt, Artificial Sequence
  Description of Artificial Sequence: Target Sequence/siNA antisense region
gcgaccuacgccggggguc

SEQ ID NO: 965 - RNA, 19 nt, Artificial Sequence
  Description of Artificial Sequence: Target Sequence/siNA antisense region
cacgacacucauacuaacg

SEQ ID NO: 966 - RNA, 19 nt, Artificial Sequence
  Description of Artificial Sequence: Target Sequence/siNA antisense region
gcacgacacucauacuaac

SEQ ID NO: 967 - RNA, 19 nt, Artificial Sequence
  Description of Artificial Sequence: Target Sequence/siNA antisense region
ugcacgacacucauacuaa

SEQ ID NO: 968 - RNA, 19 nt, Artificial Sequence
  Description of Artificial Sequence: Target Sequence/siNA antisense region
cgguugguguuacguuugg

SEQ ID NO: 969 - RNA, 19 nt, Artificial Sequence
  Description of Artificial Sequence: Target Sequence/siNA antisense region
gguugguguuacguuuggu

SEQ ID NO: 970 - RNA, 19 nt, Artificial Sequence
  Description of Artificial Sequence: Target Sequence/siNA antisense region
cucgcgggggcacgcccaa

SEQ ID NO: 971 - RNA, 19 nt, Artificial Sequence
  Description of Artificial Sequence: Target Sequence/siNA antisense region
cgcgggggcacgcccaaau

SEQ ID NO: 972 - RNA, 19 nt, Artificial Sequence
  Description of Artificial Sequence: Target Sequence/siNA antisense region
ucgcgggggcacgcccaaa

SEQ ID NO: 973 - RNA, 19 nt, Artificial Sequence
  Description of Artificial Sequence: Target Sequence/siNA antisense region
uugguguuacguuugguuu

SEQ ID NO: 974 - RNA, 19 nt, Artificial Sequence
  Description of Artificial Sequence: Target Sequence/siNA antisense region
ucucgcgggggcacgccca

SEQ ID NO: 975 - RNA, 19 nt, Artificial Sequence
  Description of Artificial Sequence: Target Sequence/siNA antisense region
acuccaccaacgaucugac

SEQ ID NO: 976 - RNA, 19 nt, Artificial Sequence
  Description of Artificial Sequence: Target Sequence/siNA antisense region
ccuggaggcugcacgacac

SEQ ID NO: 977 - RNA, 19 nt, Artificial Sequence
  Description of Artificial Sequence: Target Sequence/siNA antisense region
cuccaccaacgaucugacc

SEQ ID NO: 978 - RNA, 19 nt, Artificial Sequence
  Description of Artificial Sequence: Target Sequence/siNA antisense region
cuggaggcugcacgacacu

SEQ ID NO: 979 - RNA, 19 nt, Artificial Sequence
  Description of Artificial Sequence: Target Sequence/siNA antisense region
uggaggcugcacgacacuc

SEQ ID NO: 980 - RNA, 19 nt, Artificial Sequence
  Description of Artificial Sequence: Target Sequence/siNA antisense region
cauggugcacggucuacga

SEQ ID NO: 981 - RNA, 19 nt, Artificial Sequence
  Description of Artificial Sequence: Target Sequence/siNA antisense region
gugcucauggugcacgguc

SEQ ID NO: 982 - RNA, 19 nt, Artificial Sequence
  Description of Artificial Sequence: Target Sequence/siNA antisense region
gcugcacgacacucauacu

SEQ ID NO: 983 - RNA, 19 nt, Artificial Sequence
  Description of Artificial Sequence: Target Sequence/siNA antisense region
cugcacgacacucauacua

SEQ ID NO: 984 - RNA, 19 nt, Artificial Sequence
  Description of Artificial Sequence: Target Sequence/siNA antisense region
aacuccaccaacgaucuga

SEQ ID NO: 985 - RNA, 19 nt, Artificial Sequence
  Description of Artificial Sequence: Target Sequence/siNA antisense region
ugcucauggugcacggucu

SEQ ID NO: 986 - RNA, 19 nt, Artificial Sequence
  Description of Artificial Sequence: Target Sequence/siNA antisense region
ugguguuacguuugguuuu

SEQ ID NO: 987 - RNA, 19 nt, Artificial Sequence
  Description of Artificial Sequence: Target Sequence/siNA antisense region
cucauggugcacggucuac

SEQ ID NO: 988 - RNA, 19 nt, Artificial Sequence
  Description of Artificial Sequence: Target Sequence/siNA antisense region
auggugcacggucuacgag

SEQ ID NO: 989 - RNA, 19 nt, Artificial Sequence
  Description of Artificial Sequence: Target Sequence/siNA antisense region
ucauggugcacggucuacg

SEQ ID NO: 990 - RNA, 19 nt, Artificial Sequence
  Description of Artificial Sequence: Target Sequence/siNA antisense region
uacccgggcugagcccagg

SEQ ID NO: 991 - RNA, 19 nt, Artificial Sequence
  Description of Artificial Sequence: Target Sequence/siNA antisense region
gcucauggugcacggucua

SEQ ID NO: 992 - RNA, 19 nt, Artificial Sequence
  Description of Artificial Sequence: Target Sequence/siNA antisense region
gugcacggucuacgagacc

SEQ ID NO: 993 - RNA, 19 nt, Artificial Sequence
  Description of Artificial Sequence: Target Sequence/siNA antisense region
uggugcacggucuacgaga

SEQ ID NO: 994 - RNA, 19 nt, Artificial Sequence
  Description of Artificial Sequence: Target Sequence/siNA antisense region
ggugcacggucuacgagac

SEQ ID NO: 995 - RNA, 19 nt, Artificial Sequence
  Description of Artificial Sequence: Target Sequence/siNA antisense region
uaucgaugaccuuacccaa

SEQ ID NO: 996 - RNA, 19 nt, Artificial Sequence
  Description of Artificial Sequence: Target Sequence/siNA antisense region
uaccccaugaggucggcga

SEQ ID NO: 997 - RNA, 19 nt, Artificial Sequence
  Description of Artificial Sequence: Target Sequence/siNA antisense region
guuugguuuuucuuugagg

SEQ ID NO: 998 - RNA, 19 nt, Artificial Sequence
  Description of Artificial Sequence: Target Sequence/siNA antisense region
gucucgcgggggcacgccc

SEQ ID NO: 999 - RNA, 19 nt, Artificial Sequence
  Description of Artificial Sequence: Target Sequence/siNA antisense region
gcuaucagccgguucaucc

SEQ ID NO: 1000 - RNA, 19 nt, Artificial Sequence
  Description of Artificial Sequence: Target Sequence/siNA antisense region
cuaucagccgguucaucca

SEQ ID NO: 1001 - RNA, 19 nt, Artificial Sequence
  Description of Artificial Sequence: Target Sequence/siNA antisense region
cguuugguuuuucuuugag

SEQ ID NO: 1002 - RNA, 19 nt, Artificial Sequence
  Description of Artificial Sequence: Target Sequence/siNA antisense region
accgcucggaagucuuccu

SEQ ID NO: 1003 - RNA, 19 nt, Artificial Sequence
  Description of Artificial Sequence: Target Sequence/siNA antisense region
acguuugguuuuucuuuga

SEQ ID NO: 1004 - RNA, 19 nt, Artificial Sequence
  Description of Artificial Sequence: Target Sequence/siNA antisense region
gaccgcucggaagucuucc

SEQ ID NO: 1005 - RNA, 19 nt, Artificial Sequence
  Description of Artificial Sequence: Target Sequence/siNA antisense region
guaccccaugaggucggcg

SEQ ID NO: 1006 - RNA, 19 nt, Artificial Sequence
  Description of Artificial Sequence: Target Sequence/siNA antisense region
gguugcgaccgcucggaag

SEQ ID NO: 1007 - RNA, 19 nt, Artificial Sequence
  Description of Artificial Sequence: Target Sequence/siNA antisense region
agucucgcgggggcacgcc

SEQ ID NO: 1008 - RNA, 19 nt, Artificial Sequence
  Description of Artificial Sequence: Target Sequence/siNA antisense region
aggcugcacgacacucaua

SEQ ID NO: 1009 - RNA, 19 nt, Artificial Sequence
  Description of Artificial Sequence: Target Sequence/siNA antisense region
uagcagucucgcgggggca

SEQ ID NO: 1010 - RNA, 19 nt, Artificial Sequence
  Description of Artificial Sequence: Target Sequence/siNA antisense region
uacucggcuagcagucucg

SEQ ID NO: 1011 - RNA, 19 nt, Artificial Sequence
  Description of Artificial Sequence: Target Sequence/siNA antisense region
ggaggcugcacgacacuca

SEQ ID NO: 1012 - RNA, 19 nt, Artificial Sequence
  Description of Artificial Sequence: Target Sequence/siNA antisense region
cuagcagucucgcgggggc

SEQ ID NO: 1013 - RNA, 19 nt, Artificial Sequence
  Description of Artificial Sequence: Target Sequence/siNA antisense region
cuacucggcuagcagucuc

SEQ ID NO: 1014 - RNA, 19 nt, Artificial Sequence
  Description of Artificial Sequence: Target Sequence/siNA antisense region
gcuagcagucucgcggggg

SEQ ID NO: 1015 - RNA, 19 nt, Artificial Sequence
  Description of Artificial Sequence: Target Sequence/siNA antisense region
cucggcuagcagucucgcg

SEQ ID NO: 1016 - RNA, 19 nt, Artificial Sequence
  Description of Artificial Sequence: Target Sequence/siNA antisense region
ggcugcacgacacucauac

SEQ ID NO: 1017 - RNA, 19 nt, Artificial Sequence
  Description of Artificial Sequence: Target Sequence/siNA antisense region
gaggcugcacgacacucau

SEQ ID NO: 1018 - RNA, 19 nt, Artificial Sequence
  Description of Artificial Sequence: Target Sequence/siNA antisense region
acucggcuagcagucucgc

SEQ ID NO: 1019 - RNA, 19 nt, Artificial Sequence
  Description of Artificial Sequence: Target Sequence/siNA antisense region
ggcuagcagucucgcgggg

SEQ ID NO: 1020 - RNA, 19 nt, Artificial Sequence
  Description of Artificial Sequence: Target Sequence/siNA antisense region
ucggcuagcagucucgcgg

SEQ ID NO: 1021 - RNA, 19 nt, Artificial Sequence
  Description of Artificial Sequence: Target Sequence/siNA antisense region
cggcuagcagucucgcggg

SEQ ID NO: 1022 - RNA, 19 nt, Artificial Sequence
  Description of Artificial Sequence: Target Sequence/siNA antisense region
cagucucgcgggggcacgc

SEQ ID NO: 1023 - RNA, 19 nt, Artificial Sequence
  Description of Artificial Sequence: Target Sequence/siNA antisense region
ucucccgggaggggggguc

SEQ ID NO: 1024 - RNA, 19 nt, Artificial Sequence
  Description of Artificial Sequence: Target Sequence/siNA antisense region
ugauccaagaaaggacccg

SEQ ID NO: 1025 - RNA, 19 nt, Artificial Sequence
  Description of Artificial Sequence: Target Sequence/siNA antisense region
agcagucucgcgggggcac

SEQ ID NO: 1026 - RNA, 19 nt, Artificial Sequence
  Description of Artificial Sequence: Target Sequence/siNA antisense region
gcagucucgcgggggcacg

SEQ ID NO: 1027 - RNA, 19 nt, Artificial Sequence
  Description of Artificial Sequence: Target Sequence/siNA antisense region
accccaugaggucggcgaa

SEQ ID NO: 1028 - RNA, 19 nt, Artificial Sequence
  Description of Artificial Sequence: Target Sequence/siNA antisense region
acuugacguccugugggcg

SEQ ID NO: 1029 - RNA, 19 nt, Artificial Sequence
  Description of Artificial Sequence: Target Sequence/siNA antisense region
aacuugacguccugugggc

SEQ ID NO: 1030 - RNA, 19 nt, Artificial Sequence
  Description of Artificial Sequence: Target Sequence/siNA antisense region
cucucccgggagggggggu

SEQ ID NO: 1031 - RNA, 19 nt, Artificial Sequence
  Description of Artificial Sequence: Target Sequence/siNA antisense region
cucccgggagggggggucc

SEQ ID NO: 1032 - RNA, 19 nt, Artificial Sequence
  Description of Artificial Sequence: Target Sequence/siNA antisense region
gauccaagaaaggacccgg

SEQ ID NO: 1033 - RNA, 19 nt, Artificial Sequence
  Description of Artificial Sequence: Target Sequence/siNA antisense region
cccgggaggggggguccug

SEQ ID NO: 1034 - RNA, 19 nt, Artificial Sequence
  Description of Artificial Sequence: Target Sequence/siNA antisense region
cccgggaacuugacguccu

SEQ ID NO: 1035 - RNA, 19 nt, Artificial Sequence
  Description of Artificial Sequence: Target Sequence/siNA antisense region
ucccgggaggggggguccu

SEQ ID NO: 1036 - RNA, 19 nt, Artificial Sequence
  Description of Artificial Sequence: Target Sequence/siNA antisense region
ggaacuugacguccugugg

SEQ ID NO: 1037 - RNA, 19 nt, Artificial Sequence
  Description of Artificial Sequence: Target Sequence/siNA antisense region
ccgggaacuugacguccug

SEQ ID NO: 1038 - RNA, 19 nt, Artificial Sequence
  Description of Artificial Sequence: Target Sequence/siNA antisense region
cgggaacuugacguccugu

SEQ ID NO: 1039 - RNA, 19 nt, Artificial Sequence
  Description of Artificial Sequence: Target Sequence/siNA antisense region
gggaacuugacguccugug

SEQ ID NO: 1040 - RNA, 19 nt, Artificial Sequence
  Description of Artificial Sequence: Target Sequence/siNA antisense region
ucagccgguucauccacug

SEQ ID NO: 1041 - RNA, 19 nt, Artificial Sequence
  Description of Artificial Sequence: Target Sequence/siNA antisense region
ggguacccgggcugagccc

SEQ ID NO: 1042 - RNA, 19 nt, Artificial Sequence
  Description of Artificial Sequence: Target Sequence/siNA antisense region
cgagguugcgaccgcucgg

SEQ ID NO: 1043 - RNA, 19 nt, Artificial Sequence
  Description of Artificial Sequence: Target Sequence/siNA antisense region
guacccgggcugagcccag

SEQ ID NO: 1044 - RNA, 19 nt, Artificial Sequence
  Description of Artificial Sequence: Target Sequence/siNA antisense region
aucagccgguucauccacu

SEQ ID NO: 1045 - RNA, 19 nt, Artificial Sequence
  Description of Artificial Sequence: Target Sequence/siNA antisense region
gagguugcgaccgcucgga

SEQ ID NO: 1046 - RNA, 19 nt, Artificial Sequence
  Description of Artificial Sequence: Target Sequence/siNA antisense region
gguacccgggcugagccca

SEQ ID NO: 1047 - RNA, 19 nt, Artificial Sequence
  Description of Artificial Sequence: Target Sequence/siNA antisense region
uagaggggccaaggguacc

SEQ ID NO: 1048 - RNA, 19 nt, Artificial Sequence
  Description of Artificial Sequence: Target Sequence/siNA antisense region
agguugcgaccgcucggaa

SEQ ID NO: 1049 - RNA, 19 nt, Artificial Sequence
  Description of Artificial Sequence: Target Sequence/siNA antisense region
agaggggccaaggguaccc

SEQ ID NO: 1050 - RNA, 19 nt, Artificial Sequence
  Description of Artificial Sequence: Target Sequence/siNA antisense region
uugauccaagaaaggaccc

SEQ ID NO: 1051 - RNA, 19 nt, Artificial Sequence
  Description of Artificial Sequence: Target Sequence/siNA antisense region
gaacuugacguccuguggg

SEQ ID NO: 1052 - RNA, 19 nt, Artificial Sequence
  Description of Artificial Sequence: Target Sequence/siNA antisense region
agauagagaaagagcaacc

SEQ ID NO: 1053 - RNA, 19 nt, Artificial Sequence
  Description of Artificial Sequence: Target Sequence/siNA antisense region
caggagccauccugcccac

SEQ ID NO: 1054 - RNA, 19 nt, Artificial Sequence
  Description of Artificial Sequence: Target Sequence/siNA antisense region
aggagccauccugcccacc

SEQ ID NO: 1055 - RNA, 19 nt, Artificial Sequence
  Description of Artificial Sequence: Target Sequence/siNA antisense region
aagauagagaaagagcaac

SEQ ID NO: 1056 - RNA, 19 nt, Artificial Sequence
  Description of Artificial Sequence: Target Sequence/siNA antisense region
uaucagccgguucauccac

SEQ ID NO: 1057 - RNA, 19 nt, Artificial Sequence
  Description of Artificial Sequence: Target Sequence/siNA antisense region
ccgggaggggggguccugg

SEQ ID NO: 1058 - RNA, 19 nt, Artificial Sequence
  Description of Artificial Sequence: Target Sequence/siNA antisense region
ggagccauccugcccaccc

SEQ ID NO: 1059 - RNA, 19 nt, Artificial Sequence
  Description of Artificial Sequence: Target Sequence/siNA antisense region
agucauagccuccgugaag

SEQ ID NO: 1060 - RNA, 19 nt, Artificial Sequence
  Description of Artificial Sequence: Target Sequence/siNA antisense region
acguccugugggcggcggu

SEQ ID NO: 1061 - RNA, 19 nt, Artificial Sequence
  Description of Artificial Sequence: Target Sequence/siNA antisense region
cgggaggggggguccugga

SEQ ID NO: 1062 - RNA, 19 nt, Artificial Sequence
  Description of Artificial Sequence: Target Sequence/siNA antisense region
gaccaguucaucaucauau

SEQ ID NO: 1063 - RNA, 19 nt, Artificial Sequence
  Description of Artificial Sequence: Target Sequence/siNA antisense region
uagucauagccuccgugaa

SEQ ID NO: 1064 - RNA, 19 nt, Artificial Sequence
  Description of Artificial Sequence: Target Sequence/siNA antisense region
cuagucauagccuccguga

SEQ ID NO: 1065 - RNA, 19 nt, Artificial Sequence
  Description of Artificial Sequence: Target Sequence/siNA antisense region
acgcuaucagccgguucau

SEQ ID NO: 1066 - RNA, 19 nt, Artificial Sequence
  Description of Artificial Sequence: Target Sequence/siNA antisense region
caguucaucaucauauccc

SEQ ID NO: 1067 - RNA, 19 nt, Artificial Sequence
  Description of Artificial Sequence: Target Sequence/siNA antisense region
agccgguucauccacugca

SEQ ID NO: 1068 - RNA, 19 nt, Artificial Sequence
  Description of Artificial Sequence: Target Sequence/siNA antisense region
gccgguucauccacugcac

SEQ ID NO: 1069 - RNA, 19 nt, Artificial Sequence
  Description of Artificial Sequence: Target Sequence/siNA antisense region
aacgcuaucagccgguuca

SEQ ID NO: 1070 - RNA, 19 nt, Artificial Sequence
  Description of Artificial Sequence: Target Sequence/siNA antisense region
ccaguucaucaucauaucc

SEQ ID NO: 1071 - RNA, 19 nt, Artificial Sequence
  Description of Artificial Sequence: Target Sequence/siNA antisense region
aggaagauagagaaagagc

SEQ ID NO: 1072 - RNA, 19 nt, Artificial Sequence
  Description of Artificial Sequence: Target Sequence/siNA antisense region
augguggagugucgccccc

SEQ ID NO: 1073 - RNA, 19 nt, Artificial Sequence
  Description of Artificial Sequence: Target Sequence/siNA antisense region
cgcuaucagccgguucauc

SEQ ID NO: 1074 - RNA, 19 nt, Artificial Sequence
  Description of Artificial Sequence: Target Sequence/siNA antisense region
accaguucaucaucauauc

SEQ ID NO: 1075 - RNA, 19 nt, Artificial Sequence
  Description of Artificial Sequence: Target Sequence/siNA antisense region
aguucaucaucauauccca

SEQ ID NO: 1076 - RNA, 19 nt, Artificial Sequence
  Description of Artificial Sequence: Target Sequence/siNA antisense region
gaagauagagaaagagcaa

SEQ ID NO: 1077 - RNA, 19 nt, Artificial Sequence
  Description of Artificial Sequence: Target Sequence/siNA antisense region
ugguggagugucgccccca

SEQ ID NO: 1078 - RNA, 19 nt, Artificial Sequence
  Description of Artificial Sequence: Target Sequence/siNA antisense region
ggaagauagagaaagagca

SEQ ID NO: 1079 - RNA, 19 nt, Artificial Sequence
  Description of Artificial Sequence: Target Sequence/siNA antisense region
guugauccaagaaaggacc

SEQ ID NO: 1080 - RNA, 19 nt, Artificial Sequence
  Description of Artificial Sequence: Target Sequence/siNA antisense region
gcgaccgcucggaagucuu

SEQ ID NO: 1081 - RNA, 19 nt, Artificial Sequence
  Description of Artificial Sequence: Target Sequence/siNA antisense region
ggccaaggguacccgggcu

SEQ ID NO: 1082 - RNA, 19 nt, Artificial Sequence
  Description of Artificial Sequence: Target Sequence/siNA antisense region
agcggguugauccaagaaa

SEQ ID NO: 1083 - RNA, 19 nt, Artificial Sequence
  Description of Artificial Sequence: Target Sequence/siNA antisense region
gccaaggguacccgggcug

SEQ ID NO: 1084 - RNA, 19 nt, Artificial Sequence
  Description of Artificial Sequence: Target Sequence/siNA antisense region
ugcgaccgcucggaagucu

SEQ ID NO: 1085 - RNA, 19 nt, Artificial Sequence
  Description of Artificial Sequence: Target Sequence/siNA antisense region
gagcggguugauccaagaa

SEQ ID NO: 1086 - RNA, 19 nt, Artificial Sequence
  Description of Artificial Sequence: Target Sequence/siNA antisense region
ggggccaaggguacccggg

SEQ ID NO: 1087 - RNA, 19 nt, Artificial Sequence
  Description of Artificial Sequence: Target Sequence/siNA antisense region
gguugauccaagaaaggac

SEQ ID NO: 1088 - RNA, 19 nt, Artificial Sequence
  Description of Artificial Sequence: Target Sequence/siNA antisense region
gcggguugauccaagaaag

SEQ ID NO: 1089 - RNA, 19 nt, Artificial Sequence
  Description of Artificial Sequence: Target Sequence/siNA antisense region
cggguugauccaagaaagg

SEQ ID NO: 1090 - RNA, 19 nt, Artificial Sequence
  Description of Artificial Sequence: Target Sequence/siNA antisense region
ggguugauccaagaaagga

SEQ ID NO: 1091 - RNA, 19 nt, Artificial Sequence
  Description of Artificial Sequence: Target Sequence/siNA antisense region
gaccaccgcccgggaacuu

SEQ ID NO: 1092 - RNA, 19 nt, Artificial Sequence
  Description of Artificial Sequence: Target Sequence/siNA antisense region
cagccgguucauccacugc

SEQ ID NO: 1093 - RNA, 19 nt, Artificial Sequence
  Description of Artificial Sequence: Target Sequence/siNA antisense region
aggggccaaggguacccgg

SEQ ID NO: 1094 - RNA, 19 nt, Artificial Sequence
  Description of Artificial Sequence: Target Sequence/siNA antisense region
ugaccaccgcccgggaacu

SEQ ID NO: 1095 - RNA, 19 nt, Artificial Sequence
  Description of Artificial Sequence: Target Sequence/siNA antisense region
uugagcggguugauccaag

SEQ ID NO: 1096 - RNA, 19 nt, Artificial Sequence
  Description of Artificial Sequence: Target Sequence/siNA antisense region
gcauugagcggguugaucc

SEQ ID NO: 1097 - RNA, 19 nt, Artificial Sequence
  Description of Artificial Sequence: Target Sequence/siNA antisense region
guugcgaccgcucggaagu

SEQ ID NO: 1098 - RNA, 19 nt, Artificial Sequence
  Description of Artificial Sequence: Target Sequence/siNA antisense region
ugagcggguugauccaaga

SEQ ID NO: 1099 - RNA, 19 nt, Artificial Sequence
  Description of Artificial Sequence: Target Sequence/siNA antisense region
auugagcggguugauccaa

SEQ ID NO: 1100 - RNA, 19 nt, Artificial Sequence
  Description of Artificial Sequence: Target Sequence/siNA antisense region
cguccugugggcggcgguu

SEQ ID NO: 1101 - RNA, 19 nt, Artificial Sequence
  Description of Artificial Sequence: Target Sequence/siNA antisense region
ccuguugcauaguucacgc

SEQ ID NO: 1102 - RNA, 19 nt, Artificial Sequence
  Description of Artificial Sequence: Target Sequence/siNA antisense region
aggcauugagcggguugau

SEQ ID NO: 1103 - RNA, 19 nt, Artificial Sequence
  Description of Artificial Sequence: Target Sequence/siNA antisense region
ggcauugagcggguugauc

SEQ ID NO: 1104 - RNA, 19 nt, Artificial Sequence
  Description of Artificial Sequence: Target Sequence/siNA antisense region
ccaggcauugagcggguug

SEQ ID NO: 1105 - RNA, 19 nt, Artificial Sequence
  Description of Artificial Sequence: Target Sequence/siNA antisense region
cccaugaggucggcgaagc

SEQ ID NO: 1106 - RNA, 19 nt, Artificial Sequence
  Description of Artificial Sequence: Target Sequence/siNA antisense region
uugcgaccgcucggaaguc

SEQ ID NO: 1107 - RNA, 19 nt, Artificial Sequence
  Description of Artificial Sequence: Target Sequence/siNA antisense region
caggcauugagcggguuga

SEQ ID NO: 1108 - RNA, 19 nt, Artificial Sequence
  Description of Artificial Sequence: Target Sequence/siNA antisense region
ccaugaggucggcgaagcc

SEQ ID NO: 1109 - RNA, 19 nt, Artificial Sequence
  Description of Artificial Sequence: Target Sequence/siNA antisense region
cauugagcggguugaucca

SEQ ID NO: 1110 - RNA, 19 nt, Artificial Sequence
  Description of Artificial Sequence: Target Sequence/siNA antisense region
acgaucugaccaccgcccg

SEQ ID NO: 1111 - RNA, 19 nt, Artificial Sequence
  Description of Artificial Sequence: Target Sequence/siNA antisense region
uugccauagaggggccaag

SEQ ID NO: 1112 - RNA, 19 nt, Artificial Sequence
  Description of Artificial Sequence: Target Sequence/siNA antisense region
cgaucugaccaccgcccgg

SEQ ID NO: 1113 - RNA, 19 nt, Artificial Sequence
  Description of Artificial Sequence: Target Sequence/siNA antisense region
agccauccugcccacccca

SEQ ID NO: 1114 - RNA, 19 nt, Artificial Sequence
  Description of Artificial Sequence: Target Sequence/siNA antisense region
gcggcaacagguaaacucc

SEQ ID NO: 1115 - RNA, 19 nt, Artificial Sequence
  Description of Artificial Sequence: Target Sequence/siNA antisense region
ugccauagaggggccaagg

SEQ ID NO: 1116 - RNA, 19 nt, Artificial Sequence
  Description of Artificial Sequence: Target Sequence/siNA antisense region
ggcaacagguaaacuccac

SEQ ID NO: 1117 - RNA, 19 nt, Artificial Sequence
  Description of Artificial Sequence: Target Sequence/siNA antisense region
gcaacagguaaacuccacc

SEQ ID NO: 1118 - RNA, 19 nt, Artificial Sequence
  Description of Artificial Sequence: Target Sequence/siNA antisense region
ucugaccaccgcccgggaa

SEQ ID NO: 1119 - RNA, 19 nt, Artificial Sequence
  Description of Artificial Sequence: Target Sequence/siNA antisense region
uucccuguugcauaguuca

SEQ ID NO: 1120 - RNA, 19 nt, Artificial Sequence
  Description of Artificial Sequence: Target Sequence/siNA antisense region
gcgcggcaacagguaaacu

SEQ ID NO: 1121 - RNA, 19 nt, Artificial Sequence
  Description of Artificial Sequence: Target Sequence/siNA antisense region
ucccuguugcauaguucac

SEQ ID NO: 1122 - RNA, 19 nt, Artificial Sequence
  Description of Artificial Sequence: Target Sequence/siNA antisense region
ccugcgcggcaacagguaa

SEQ ID NO: 1123 - RNA, 19 nt, Artificial Sequence
  Description of Artificial Sequence: Target Sequence/siNA antisense region
aucugaccaccgcccggga

SEQ ID NO: 1124 - RNA, 19 nt, Artificial Sequence
  Description of Artificial Sequence: Target Sequence/siNA antisense region
cugaccaccgcccgggaac

SEQ ID NO: 1125 - RNA, 19 nt, Artificial Sequence
  Description of Artificial Sequence: Target Sequence/siNA antisense region
gggccaaggguacccgggc

SEQ ID NO: 1126 - RNA, 19 nt, Artificial Sequence
  Description of Artificial Sequence: Target Sequence/siNA antisense region
ccuucgccuucaucuccuu

SEQ ID NO: 1127 - RNA, 19 nt, Artificial Sequence
  Description of Artificial Sequence: Target Sequence/siNA antisense region
gccuucgccuucaucuccu

SEQ ID NO: 1128 - RNA, 19 nt, Artificial Sequence
  Description of Artificial Sequence: Target Sequence/siNA antisense region
ugcgcggcaacagguaaac

SEQ ID NO: 1129 - RNA, 19 nt, Artificial Sequence
  Description of Artificial Sequence: Target Sequence/siNA antisense region
ggccccugcgcggcaacag

SEQ ID NO: 1130 - RNA, 19 nt, Artificial Sequence
  Description of Artificial Sequence: Target Sequence/siNA antisense region
gugggcggcgguugguguu

SEQ ID NO: 1131 - RNA, 19 nt, Artificial Sequence
  Description of Artificial Sequence: Target Sequence/siNA antisense region
cgcggcaacagguaaacuc

SEQ ID NO: 1132 - RNA, 19 nt, Artificial Sequence
  Description of Artificial Sequence: Target Sequence/siNA antisense region
cugcgcggcaacagguaaa

SEQ ID NO: 1133 - RNA, 19 nt, Artificial Sequence
  Description of Artificial Sequence: Target Sequence/siNA antisense region
gagccauccugcccacccc

SEQ ID NO: 1134 - RNA, 19 nt, Artificial Sequence
  Description of Artificial Sequence: Target Sequence/siNA antisense region
cgaccgcucggaagucuuc

SEQ ID NO: 1135 - RNA, 19 nt, Artificial Sequence
  Description of Artificial Sequence: Target Sequence/siNA antisense region
ccccugcgcggcaacaggu

SEQ ID NO: 1136 - RNA, 19 nt, Artificial Sequence
  Description of Artificial Sequence: Target Sequence/siNA antisense region
cccugcgcggcaacaggua

SEQ ID NO: 1137 - RNA, 19 nt, Artificial Sequence
  Description of Artificial Sequence: Target Sequence/siNA antisense region
cugcccaguugaagaggua

SEQ ID NO: 1138 - RNA, 19 nt, Artificial Sequence
  Description of Artificial Sequence: Target Sequence/siNA antisense region
cccuguugcauaguucacg

SEQ ID NO: 1139 - RNA, 19 nt, Artificial Sequence
  Description of Artificial Sequence: Target Sequence/siNA antisense region
ugugggcggcgguuggugu

SEQ ID NO: 1140 - RNA, 19 nt, Artificial Sequence
  Description of Artificial Sequence: Target Sequence/siNA antisense region
gaucugaccaccgcccggg

SEQ ID NO: 1141 - RNA, 19 nt, Artificial Sequence
  Description of Artificial Sequence: Target Sequence/siNA antisense region
acugcccaguugaagaggu

SEQ ID NO: 1142 - RNA, 19 nt, Artificial Sequence
  Description of Artificial Sequence: Target Sequence/siNA antisense region
ccccaugaggucggcgaag

SEQ ID NO: 1143 - RNA, 19 nt, Artificial Sequence
  Description of Artificial Sequence: Target Sequence/siNA antisense region
gccccugcgcggcaacagg

SEQ ID NO: 1144 - RNA, 19 nt, Artificial Sequence
  Description of Artificial Sequence: Target Sequence/siNA antisense region
uccugugggcggcgguugg

SEQ ID NO: 1145 - RNA, 19 nt, Artificial Sequence
  Description of Artificial Sequence: Target Sequence/siNA antisense region
ccugugggcggcgguuggu

SEQ ID NO: 1146 - RNA, 19 nt, Artificial Sequence
  Description of Artificial Sequence: Target Sequence/siNA antisense region
cggcaacagguaaacucca

SEQ ID NO: 1147 - RNA, 19 nt, Artificial Sequence
  Description of Artificial Sequence: Target Sequence/siNA antisense region
cugugggcggcgguuggug

SEQ ID NO: 1148 - RNA, 19 nt, Artificial Sequence
  Description of Artificial Sequence: Target Sequence/siNA antisense region
gcgguugguguuacguuug

SEQ ID NO: 1149 - RNA, 19 nt, Artificial Sequence
  Description of Artificial Sequence: Target Sequence/siNA antisense region
cuccagccgucuccgcuug

SEQ ID NO: 1150 - RNA, 19 nt, Artificial Sequence
  Description of Artificial Sequence: Target Sequence/siNA antisense region
accuagucauagccuccgu

SEQ ID NO: 1151 - RNA, 19 nt, Artificial Sequence
  Description of Artificial Sequence: Target Sequence/siNA antisense region
ugggcggcgguugguguua

SEQ ID NO: 1152 - RNA, 19 nt, Artificial Sequence
  Description of Artificial Sequence: Target Sequence/siNA antisense region
gguaaacuccaccaacgau

SEQ ID NO: 1153 - RNA, 19 nt, Artificial Sequence
  Description of Artificial Sequence: Target Sequence/siNA antisense region
gcugugauauaugucuccc

SEQ ID NO: 1154 - RNA, 19 nt, Artificial Sequence
  Description of Artificial Sequence: Target Sequence/siNA antisense region
ugucgccuuccacgagguu

SEQ ID NO: 1155 - RNA, 19 nt, Artificial Sequence
  Description of Artificial Sequence: Target Sequence/siNA antisense region
ugugauauaugucuccccc

SEQ ID NO: 1156 - RNA, 19 nt, Artificial Sequence
  Description of Artificial Sequence: Target Sequence/siNA antisense region
cggcgguugguguuacguu

SEQ ID NO: 1157 - RNA, 19 nt, Artificial Sequence
  Description of Artificial Sequence: Target Sequence/siNA antisense region
ggcgguugguguuacguuu

SEQ ID NO: 1158 - RNA, 19 nt, Artificial Sequence
  Description of Artificial Sequence: Target Sequence/siNA antisense region
cugugauauaugucucccc

SEQ ID NO: 1159 - RNA, 19 nt, Artificial Sequence
  Description of Artificial Sequence: Target Sequence/siNA antisense region
acgccuucgccuucaucuc

SEQ ID NO: 1160 - RNA, 19 nt, Artificial Sequence
  Description of Artificial Sequence: Target Sequence/siNA antisense region
gcuccagccgucuccgcuu

SEQ ID NO: 1161 - RNA, 19 nt, Artificial Sequence
  Description of Artificial Sequence: Target Sequence/siNA antisense region
auagaggggccaaggguac

SEQ ID NO: 1162 - RNA, 19 nt, Artificial Sequence
  Description of Artificial Sequence: Target Sequence/siNA antisense region
ggaggggggguccuggagg

SEQ ID NO: 1163 - RNA, 19 nt, Artificial Sequence
  Description of Artificial Sequence: Target Sequence/siNA antisense region
gggaggggggguccuggag

SEQ ID NO: 1164 - RNA, 19 nt, Artificial Sequence
  Description of Artificial Sequence: Target Sequence/siNA antisense region
cauagaggggccaagggua

SEQ ID NO: 1165 - RNA, 19 nt, Artificial Sequence
  Description of Artificial Sequence: Target Sequence/siNA antisense region
gucgccuuccacgagguug

SEQ ID NO: 1166 - RNA, 19 nt, Artificial Sequence
  Description of Artificial Sequence: Target Sequence/siNA antisense region
uaccuagucauagccuccg

SEQ ID NO: 1167 - RNA, 19 nt, Artificial Sequence
  Description of Artificial Sequence: Target Sequence/siNA antisense region
cgccuucgccuucaucucc

SEQ ID NO: 1168 - RNA, 19 nt, Artificial Sequence
  Description of Artificial Sequence: Target Sequence/siNA antisense region
gacgccuucgccuucaucu

SEQ ID NO: 1169 - RNA, 19 nt, Artificial Sequence
  Description of Artificial Sequence: Target Sequence/siNA antisense region
gggcggcgguugguguuac

SEQ ID NO: 1170 - RNA, 19 nt, Artificial Sequence
  Description of Artificial Sequence: Target Sequence/siNA antisense region
ggcggcgguugguguuacg

SEQ ID NO: 1171 - RNA, 19 nt, Artificial Sequence
  Description of Artificial Sequence: Target Sequence/siNA antisense region
gcggcgguugguguuacgu

SEQ ID NO: 1172 - RNA, 19 nt, Artificial Sequence
  Description of Artificial Sequence: Target Sequence/siNA antisense region
ccuagucauagccuccgug

SEQ ID NO: 1173 - RNA, 19 nt, Artificial Sequence
  Description of Artificial Sequence: Target Sequence/siNA antisense region
acagguaaacuccaccaac

SEQ ID NO: 1174 - RNA, 19 nt, Artificial Sequence
  Description of Artificial Sequence: Target Sequence/siNA antisense region
cagguaaacuccaccaacg

SEQ ID NO: 1175 - RNA, 19 nt, Artificial Sequence
  Description of Artificial Sequence: Target Sequence/siNA antisense region
ccauagaggggccaagggu

SEQ ID NO: 1176 - RNA, 19 nt, Artificial Sequence
  Description of Artificial Sequence: Target Sequence/siNA antisense region
aacagguaaacuccaccaa

SEQ ID NO: 1177 - RNA, 19 nt, Artificial Sequence
  Description of Artificial Sequence: Target Sequence/siNA antisense region
caacagguaaacuccacca

SEQ ID NO: 1178 - RNA, 19 nt, Artificial Sequence
  Description of Artificial Sequence: Target Sequence/siNA antisense region
agguaaacuccaccaacga

SEQ ID NO: 1179 - RNA, 19 nt, Artificial Sequence
  Description of Artificial Sequence: Target Sequence/siNA antisense region
gaggggccaaggguacccg

SEQ ID NO: 1180 - RNA, 19 nt, Artificial Sequence
  Description of Artificial Sequence: Target Sequence/siNA antisense region
aggguacccgggcugagcc

SEQ ID NO: 1181 - RNA, 19 nt, Artificial Sequence
  Description of Artificial Sequence: Target Sequence/siNA antisense region
uccucacaggggagugauc

SEQ ID NO: 1182 - RNA, 19 nt, Artificial Sequence
  Description of Artificial Sequence: Target Sequence/siNA antisense region
caccaacgaucugaccacc

SEQ ID NO: 1183 - RNA, 19 nt, Artificial Sequence
  Description of Artificial Sequence: Target Sequence/siNA antisense region
ggacgccuucgccuucauc

SEQ ID NO: 1184 - RNA, 19 nt, Artificial Sequence
  Description of Artificial Sequence: Target Sequence/siNA antisense region
gggugacaggagccauccu

SEQ ID NO: 1185 - RNA, 19 nt, Artificial Sequence
  Description of Artificial Sequence: Target Sequence/siNA antisense region
caaggguacccgggcugag

SEQ ID NO: 1186 - RNA, 19 nt, Artificial Sequence
  Description of Artificial Sequence: Target Sequence/siNA antisense region
ccaaggguacccgggcuga

SEQ ID NO: 1187 - RNA, 19 nt, Artificial Sequence
  Description of Artificial Sequence: Target Sequence/siNA antisense region
uggacgccuucgccuucau

SEQ ID NO: 1188 - RNA, 19 nt, Artificial Sequence
  Description of Artificial Sequence: Target Sequence/siNA antisense region
gugauauaugucucccccg

SEQ ID NO: 1189 - RNA, 19 nt, Artificial Sequence
  Description of Artificial Sequence: Target Sequence/siNA antisense region
ggugacaggagccauccug

SEQ ID NO: 1190 - RNA, 19 nt, Artificial Sequence
  Description of Artificial Sequence: Target Sequence/siNA antisense region
guggacgccuucgccuuca

SEQ ID NO: 1191 - RNA, 19 nt, Artificial Sequence
  Description of Artificial Sequence: Target Sequence/siNA antisense region
uccaccaacgaucugacca

SEQ ID NO: 1192 - RNA, 19 nt, Artificial Sequence
  Description of Artificial Sequence: Target Sequence/siNA antisense region
aaggguacccgggcugagc

SEQ ID NO: 1193 - RNA, 19 nt, Artificial Sequence
  Description of Artificial Sequence: Target Sequence/siNA antisense region
ccaccaacgaucugaccac

SEQ ID NO: 1194 - RNA, 19 nt, Artificial Sequence
  Description of Artificial Sequence: Target Sequence/siNA antisense region
ggggggguccuggaggcug

SEQ ID NO: 1195 - RNA, 19 nt, Artificial Sequence
  Description of Artificial Sequence: Target Sequence/siNA antisense region
caacgaucugaccaccgcc

SEQ ID NO: 1196 - RNA, 19 nt, Artificial Sequence
  Description of Artificial Sequence: Target Sequence/siNA antisense region
gaggggggguccuggaggc

SEQ ID NO: 1197 - RNA, 19 nt, Artificial Sequence
  Description of Artificial Sequence: Target Sequence/siNA antisense region
cgaacgcuaucagccgguu

SEQ ID NO: 1198 - RNA, 19 nt, Artificial Sequence
  Description of Artificial Sequence: Target Sequence/siNA antisense region
aggggggguccuggaggcu

SEQ ID NO: 1199 - RNA, 19 nt, Artificial Sequence
  Description of Artificial Sequence: Target Sequence/siNA antisense region
caugaggucggcgaagccg

SEQ ID NO: 1200 - RNA, 19 nt, Artificial Sequence
  Description of Artificial Sequence: Target Sequence/siNA antisense region
gcgcuccagccgucuccgc

SEQ ID NO: 1201 - RNA, 19 nt, Artificial Sequence
  Description of Artificial Sequence: Target Sequence/siNA antisense region
agcggaauguaccccauga

SEQ ID NO: 1202 - RNA, 19 nt, Artificial Sequence
  Description of Artificial Sequence: Target Sequence/siNA antisense region
gaacgcuaucagccgguuc

SEQ ID NO: 1203 - RNA, 19 nt, Artificial Sequence
  Description of Artificial Sequence: Target Sequence/siNA antisense region
ccaacgaucugaccaccgc

SEQ ID NO: 1204 - RNA, 19 nt, Artificial Sequence
  Description of Artificial Sequence: Target Sequence/siNA antisense region
ugacaggagccauccugcc

SEQ ID NO: 1205 - RNA, 19 nt, Artificial Sequence
  Description of Artificial Sequence: Target Sequence/siNA antisense region
gugacaggagccauccugc

SEQ ID NO: 1206 - RNA, 19 nt, Artificial Sequence
  Description of Artificial Sequence: Target Sequence/siNA antisense region
ucgaugaccuuacccaaau

SEQ ID NO: 1207 - RNA, 19 nt, Artificial Sequence
  Description of Artificial Sequence: Target Sequence/siNA antisense region
gcgaacgcuaucagccggu

SEQ ID NO: 1208 - RNA, 19 nt, Artificial Sequence
  Description of Artificial Sequence: Target Sequence/siNA antisense region
cgcgcuccagccgucuccg

SEQ ID NO: 1209 - RNA, 19 nt, Artificial Sequence
  Description of Artificial Sequence: Target Sequence/siNA antisense region
augaggucggcgaagccgc

SEQ ID NO: 1210 - RNA, 19 nt, Artificial Sequence
  Description of Artificial Sequence: Target Sequence/siNA antisense region
cgaugaccuuacccaaauu

SEQ ID NO: 1211 - RNA, 19 nt, Artificial Sequence
  Description of Artificial Sequence: Target Sequence/siNA antisense region
aacgaucugaccaccgccc

SEQ ID NO: 1212 - RNA, 19 nt, Artificial Sequence
  Description of Artificial Sequence: Target Sequence/siNA antisense region
guccugugggcggcgguug

SEQ ID NO: 1213 - RNA, 19 nt, Artificial Sequence
  Description of Artificial Sequence: Target Sequence/siNA antisense region
ugaggucggcgaagccgca

SEQ ID NO: 1214 - RNA, 19 nt, Artificial Sequence
  Description of Artificial Sequence: Target Sequence/siNA antisense region
accaacgaucugaccaccg

SEQ ID NO: 1215 - RNA, 19 nt, Artificial Sequence
  Description of Artificial Sequence: Target Sequence/siNA antisense region
uagucgcgcgcacacccaa

SEQ ID NO: 1216 - RNA, 19 nt, Artificial Sequence
  Description of Artificial Sequence: Target Sequence/siNA antisense region
uuccuagucgcgcgcacac

SEQ ID NO: 1217 - RNA, 19 nt, Artificial Sequence
  Description of Artificial Sequence: Target Sequence/siNA antisense region
cggggugacaggagccauc

SEQ ID NO: 1218 - RNA, 19 nt, Artificial Sequence
  Description of Artificial Sequence: Target Sequence/siNA antisense region
ggggugacaggagccaucc

SEQ ID NO: 1219 - RNA, 19 nt, Artificial Sequence
  Description of Artificial Sequence: Target Sequence/siNA antisense region
cuuccuagucgcgcgcaca

SEQ ID NO: 1220 - RNA, 19 nt, Artificial Sequence
  Description of Artificial Sequence: Target Sequence/siNA antisense region
cuagucgcgcgcacaccca

SEQ ID NO: 1221 - RNA, 19 nt, Artificial Sequence
  Description of Artificial Sequence: Target Sequence/siNA antisense region
uccuagucgcgcgcacacc

SEQ ID NO: 1222 - RNA, 19 nt, Artificial Sequence
  Description of Artificial Sequence: Target Sequence/siNA antisense region
ccuagucgcgcgcacaccc

SEQ ID NO: 1223 - RNA, 19 nt, Artificial Sequence
  Description of Artificial Sequence: Target Sequence/siNA antisense region
uacgcgaccuacgccgggg

SEQ ID NO: 1224 - RNA, 19 nt, Artificial Sequence
  Description of Artificial Sequence: Target Sequence/siNA antisense region
gggauagguugucgccuuc

SEQ ID NO: 1225 - RNA, 19 nt, Artificial Sequence
  Description of Artificial Sequence: Target Sequence/siNA antisense region
uuacgcgaccuacgccggg

SEQ ID NO: 1226 - RNA, 19 nt, Artificial Sequence
  Description of Artificial Sequence: Target Sequence/siNA antisense region
cgcuccagccgucuccgcu

SEQ ID NO: 1227 - RNA, 19 nt, Artificial Sequence
  Description of Artificial Sequence: Target Sequence/siNA antisense region
acgcgaccuacgccggggg

SEQ ID NO: 1228 - RNA, 19 nt, Artificial Sequence
  Description of Artificial Sequence: Target Sequence/siNA antisense region
acuguggacgccuucgccu

SEQ ID NO: 1229 - RNA, 19 nt, Artificial Sequence
  Description of Artificial Sequence: Target Sequence/siNA antisense region
cuguggacgccuucgccuu

SEQ ID NO: 1230 - RNA, 19 nt, Artificial Sequence
  Description of Artificial Sequence: Target Sequence/siNA antisense region
agucgcgcgcacacccaac

SEQ ID NO: 1231 - RNA, 19 nt, Artificial Sequence
  Description of Artificial Sequence: Target Sequence/siNA antisense region
gcggaauguaccccaugag

SEQ ID NO: 1232 - RNA, 19 nt, Artificial Sequence
  Description of Artificial Sequence: Target Sequence/siNA antisense region
ggauagguugucgccuucc

SEQ ID NO: 1233 - RNA, 19 nt, Artificial Sequence
  Description of Artificial Sequence: Target Sequence/siNA antisense region
ccgucggcaaggaacuugc

SEQ ID NO: 1234 - RNA, 19 nt, Artificial Sequence
  Description of Artificial Sequence: Target Sequence/siNA antisense region
ggggguccuggaggcugca

SEQ ID NO: 1235 - RNA, 19 nt, Artificial Sequence
  Description of Artificial Sequence: Target Sequence/siNA antisense region
cacgagcaucgugcagucc

SEQ ID NO: 1236 - RNA, 19 nt, Artificial Sequence
  Description of Artificial Sequence: Target Sequence/siNA antisense region
uguggacgccuucgccuuc

SEQ ID NO: 1237 - RNA, 19 nt, Artificial Sequence
  Description of Artificial Sequence: Target Sequence/siNA antisense region
ucgccuuccacgagguugc

SEQ ID NO: 1238 - RNA, 19 nt, Artificial Sequence
  Description of Artificial Sequence: Target Sequence/siNA antisense region
accaagcacagcccgcguc

SEQ ID NO: 1239 - RNA, 19 nt, Artificial Sequence
  Description of Artificial Sequence: Target Sequence/siNA antisense region
uaccaagcacagcccgcgu

SEQ ID NO: 1240 - RNA, 19 nt, Artificial Sequence
  Description of Artificial Sequence: Target Sequence/siNA antisense region
gggguccuggaggcugcac

SEQ ID NO: 1241 - RNA, 19 nt, Artificial Sequence
  Description of Artificial Sequence: Target Sequence/siNA antisense region
gggggguccuggaggcugc

SEQ ID NO: 1242 - RNA, 19 nt, Artificial Sequence
  Description of Artificial Sequence: Target Sequence/siNA antisense region
cgccuuccacgagguugcg

SEQ ID NO: 1243 - RNA, 19 nt, Artificial Sequence
  Description of Artificial Sequence: Target Sequence/siNA antisense region
uccuggaggcugcacgaca

SEQ ID NO: 1244 - RNA, 19 nt, Artificial Sequence
  Description of Artificial Sequence: Target Sequence/siNA antisense region
ucaucauaucccaagccau

SEQ ID NO: 1245 - RNA, 19 nt, Artificial Sequence
  Description of Artificial Sequence: Target Sequence/siNA antisense region
uucaucaucauaucccaag

SEQ ID NO: 1246 - RNA, 19 nt, Artificial Sequence
  Description of Artificial Sequence: Target Sequence/siNA antisense region
gccauagaggggccaaggg

SEQ ID NO: 1247 - RNA, 19 nt, Artificial Sequence
  Description of Artificial Sequence: Target Sequence/siNA antisense region
aucaucauaucccaagcca

SEQ ID NO: 1248 - RNA, 19 nt, Artificial Sequence
  Description of Artificial Sequence: Target Sequence/siNA antisense region
cgguucauccacugcacag

SEQ ID NO: 1249 - RNA, 19 nt, Artificial Sequence
  Description of Artificial Sequence: Target Sequence/siNA antisense region
caagcacagcccgcgucau

SEQ ID NO: 1250 - RNA, 19 nt, Artificial Sequence
  Description of Artificial Sequence: Target Sequence/siNA antisense region
ucaucaucauaucccaagc

SEQ ID NO: 1251 - RNA, 19 nt, Artificial Sequence
  Description of Artificial Sequence: Target Sequence/siNA antisense region
aagcacagcccgcgucaua

SEQ ID NO: 1252 - RNA, 19 nt, Artificial Sequence
  Description of Artificial Sequence: Target Sequence/siNA antisense region
ccaagcacagcccgcguca

SEQ ID NO: 1253 - RNA, 19 nt, Artificial Sequence
  Description of Artificial Sequence: Target Sequence/siNA antisense region
caucaucauaucccaagcc

SEQ ID NO: 1254 - RNA, 19 nt, Artificial Sequence
  Description of Artificial Sequence: Target Sequence/siNA antisense region
ccgguucauccacugcaca

SEQ ID NO: 1255 - RNA, 19 nt, Artificial Sequence
  Description of Artificial Sequence: Target Sequence/siNA antisense region
gguucauccacugcacagc

SEQ ID NO: 1256 - RNA, 19 nt, Artificial Sequence
  Description of Artificial Sequence: Target Sequence/siNA antisense region
uuacugcccaguugaagag

SEQ ID NO: 1257 - RNA, 19 nt, Artificial Sequence
  Description of Artificial Sequence: Target Sequence/siNA antisense region
guugucgccuuccacgagg

SEQ ID NO: 1258 - RNA, 19 nt, Artificial Sequence
  Description of Artificial Sequence: Target Sequence/siNA antisense region
cgacugucugggugacaca

SEQ ID NO: 1259 - RNA, 19 nt, Artificial Sequence
  Description of Artificial Sequence: Target Sequence/siNA antisense region
cuguugcauaguucacgcc

SEQ ID NO: 1260 - RNA, 19 nt, Artificial Sequence
  Description of Artificial Sequence: Target Sequence/siNA antisense region
uguugcauaguucacgccg

SEQ ID NO: 1261 - RNA, 19 nt, Artificial Sequence
  Description of Artificial Sequence: Target Sequence/siNA antisense region
ucgacugucugggugacac

SEQ ID NO: 1262 - RNA, 19 nt, Artificial Sequence
  Description of Artificial Sequence: Target Sequence/siNA antisense region
uacugcccaguugaagagg

SEQ ID NO: 1263 - RNA, 19 nt, Artificial Sequence
  Description of Artificial Sequence: Target Sequence/siNA antisense region
uagguugucgccuuccacg

SEQ ID NO: 1264 - RNA, 19 nt, Artificial Sequence
  Description of Artificial Sequence: Target Sequence/siNA antisense region
agguugucgccuuccacga

SEQ ID NO: 1265 - RNA, 19 nt, Artificial Sequence
  Description of Artificial Sequence: Target Sequence/siNA antisense region
uggggccccaacuaggccg

SEQ ID NO: 1266 - RNA, 19 nt, Artificial Sequence
  Description of Artificial Sequence: Target Sequence/siNA antisense region
ucggaagucuuccuagucg

SEQ ID NO: 1267 - RNA, 19 nt, Artificial Sequence
  Description of Artificial Sequence: Target Sequence/siNA antisense region
aucgaugaccuuacccaaa

SEQ ID NO: 1268 - RNA, 19 nt, Artificial Sequence
  Description of Artificial Sequence: Target Sequence/siNA antisense region
auagguugucgccuuccac

SEQ ID NO: 1269 - RNA, 19 nt, Artificial Sequence
  Description of Artificial Sequence: Target Sequence/siNA antisense region
uugucgccuuccacgaggu

SEQ ID NO: 1270 - RNA, 19 nt, Artificial Sequence
  Description of Artificial Sequence: Target Sequence/siNA antisense region
cggaagucuuccuagucgc

SEQ ID NO: 1271 - RNA, 19 nt, Artificial Sequence
  Description of Artificial Sequence: Target Sequence/siNA antisense region
guccuggaggcugcacgac

SEQ ID NO: 1272 - RNA, 19 nt, Artificial Sequence
  Description of Artificial Sequence: Target Sequence/siNA antisense region
ccgcucggaagucuuccua

SEQ ID NO: 1273 - RNA, 19 nt, Artificial Sequence
  Description of Artificial Sequence: Target Sequence/siNA antisense region
guugcauaguucacgccgu

SEQ ID NO: 1274 - RNA, 19 nt, Artificial Sequence
  Description of Artificial Sequence: Target Sequence/siNA antisense region
gguugucgccuuccacgag

SEQ ID NO: 1275 - RNA, 19 nt, Artificial Sequence
  Description of Artificial Sequence: Target Sequence/siNA antisense region
cuuccacgagguugcgacc

SEQ ID NO: 1276 - RNA, 19 nt, Artificial Sequence
  Description of Artificial Sequence: Target Sequence/siNA antisense region
uuccacgagguugcgaccg

SEQ ID NO: 1277 - RNA, 19 nt, Artificial Sequence
  Description of Artificial Sequence: Target Sequence/siNA antisense region
agucuuccuagucgcgcgc

SEQ ID NO: 1278 - RNA, 19 nt, Artificial Sequence
  Description of Artificial Sequence: Target Sequence/siNA antisense region
uugcauaguucacgccguc

SEQ ID NO: 1279 - RNA, 19 nt, Artificial Sequence
  Description of Artificial Sequence: Target Sequence/siNA antisense region
cucacaggggagugaucua

SEQ ID NO: 1280 - RNA, 19 nt, Artificial Sequence
  Description of Artificial Sequence: Target Sequence/siNA antisense region
ccacgagguugcgaccgcu

SEQ ID NO: 1281 - RNA, 19 nt, Artificial Sequence
  Description of Artificial Sequence: Target Sequence/siNA antisense region
gauagguugucgccuucca

SEQ ID NO: 1282 - RNA, 19 nt, Artificial Sequence
  Description of Artificial Sequence: Target Sequence/siNA antisense region
aagucuuccuagucgcgcg

SEQ ID NO: 1283 - RNA, 19 nt, Artificial Sequence
  Description of Artificial Sequence: Target Sequence/siNA antisense region
cgcucggaagucuuccuag

SEQ ID NO: 1284 - RNA, 19 nt, Artificial Sequence
  Description of Artificial Sequence: Target Sequence/siNA antisense region
ucuuccuagucgcgcgcac

SEQ ID NO: 1285 - RNA, 19 nt, Artificial Sequence
  Description of Artificial Sequence: Target Sequence/siNA antisense region
ccucacaggggagugaucu

SEQ ID NO: 1286 - RNA, 19 nt, Artificial Sequence
  Description of Artificial Sequence: Target Sequence/siNA antisense region
gucuuccuagucgcgcgca

SEQ ID NO: 1287 - RNA, 19 nt, Artificial Sequence
  Description of Artificial Sequence: Target Sequence/siNA antisense region
ucacaggggagugaucuau

SEQ ID NO: 1288 - RNA, 19 nt, Artificial Sequence
  Description of Artificial Sequence: Target Sequence/siNA antisense region
cacgagguugcgaccgcuc

SEQ ID NO: 1289 - RNA, 19 nt, Artificial Sequence
  Description of Artificial Sequence: Target Sequence/siNA antisense region
guuggagcagucguucgug

SEQ ID NO: 1290 - RNA, 19 nt, Artificial Sequence
  Description of Artificial Sequence: Target Sequence/siNA antisense region
cgucggcaaggaacuugcc

SEQ ID NO: 1291 - RNA, 19 nt, Artificial Sequence
  Description of Artificial Sequence: Target Sequence/siNA antisense region
gguccuggaggcugcacga

SEQ ID NO: 1292 - RNA, 19 nt, Artificial Sequence
  Description of Artificial Sequence: Target Sequence/siNA antisense region
uggagcagucguucgugac

SEQ ID NO: 1293 - RNA, 19 nt, Artificial Sequence
  Description of Artificial Sequence: Target Sequence/siNA antisense region
uccacgagguugcgaccgc

SEQ ID NO: 1294 - RNA, 19 nt, Artificial Sequence
  Description of Artificial Sequence: Target Sequence/siNA antisense region
gaagucuuccuagucgcgc

SEQ ID NO: 1295 - RNA, 19 nt, Artificial Sequence
  Description of Artificial Sequence: Target Sequence/siNA antisense region
gcacagcccgcgucauagc

SEQ ID NO: 1296 - RNA, 19 nt, Artificial Sequence
  Description of Artificial Sequence: Target Sequence/siNA antisense region
uuggagcagucguucguga

SEQ ID NO: 1297 - RNA, 19 nt, Artificial Sequence
  Description of Artificial Sequence: Target Sequence/siNA antisense region
gccuuccacgagguugcga

SEQ ID NO: 1298 - RNA, 19 nt, Artificial Sequence
  Description of Artificial Sequence: Target Sequence/siNA antisense region
ggguccuggaggcugcacg

SEQ ID NO: 1299 - RNA, 19 nt, Artificial Sequence
  Description of Artificial Sequence: Target Sequence/siNA antisense region
ccuuccacgagguugcgac

SEQ ID NO: 1300 - RNA, 19 nt, Artificial Sequence
  Description of Artificial Sequence: Target Sequence/siNA antisense region
gcucggaagucuuccuagu

SEQ ID NO: 1301 - RNA, 19 nt, Artificial Sequence
  Description of Artificial Sequence: Target Sequence/siNA antisense region
ggaagucuuccuagucgcg

SEQ ID NO: 1302 - RNA, 19 nt, Artificial Sequence
  Description of Artificial Sequence: Target Sequence/siNA antisense region
uccacaugugcuucgccca

SEQ ID NO: 1303 - RNA, 19 nt, Artificial Sequence
  Description of Artificial Sequence: Target Sequence/siNA antisense region
cauggaauaguaggcaagg

SEQ ID NO: 1304 - RNA, 19 nt, Artificial Sequence
  Description of Artificial Sequence: Target Sequence/siNA antisense region
accccaaguuuccugaggc

SEQ ID NO: 1305 - RNA, 19 nt, Artificial Sequence
  Description of Artificial Sequence: Target Sequence/siNA antisense region
cacagcccgcgucauagca

SEQ ID NO: 1306 - RNA, 19 nt, Artificial Sequence
  Description of Artificial Sequence: Target Sequence/siNA antisense region
guagcgguggcgagcacga

SEQ ID NO: 1307 - RNA, 19 nt, Artificial Sequence
  Description of Artificial Sequence: Target Sequence/siNA antisense region
ccccaaguuuccugaggca

SEQ ID NO: 1308 - RNA, 19 nt, Artificial Sequence
  Description of Artificial Sequence: Target Sequence/siNA antisense region
cggggucgggcacgagaca

SEQ ID NO: 1309 - RNA, 19 nt, Artificial Sequence
  Description of Artificial Sequence: Target Sequence/siNA antisense region
cccaucuccugccgccaca

SEQ ID NO: 1310 - RNA, 19 nt, Artificial Sequence
  Description of Artificial Sequence: Target Sequence/siNA antisense region
uagcgguggcgagcacgac

SEQ ID NO: 1311 - RNA, 19 nt, Artificial Sequence
  Description of Artificial Sequence: Target Sequence/siNA antisense region
ccgucacguaguggaaauc

SEQ ID NO: 1312 - RNA, 19 nt, Artificial Sequence
  Description of Artificial Sequence: Target Sequence/siNA antisense region
ggaauaguaggcaaggccc

SEQ ID NO: 1313 - RNA, 19 nt, Artificial Sequence
  Description of Artificial Sequence: Target Sequence/siNA antisense region
auggaauaguaggcaaggc

SEQ ID NO: 1314 - RNA, 19 nt, Artificial Sequence
  Description of Artificial Sequence: Target Sequence/siNA antisense region
cucggaagucuuccuaguc

SEQ ID NO: 1315 - RNA, 19 nt, Artificial Sequence
  Description of Artificial Sequence: Target Sequence/siNA antisense region
ugauauaugucucccccgc

SEQ ID NO: 1316 - RNA, 19 nt, Artificial Sequence
  Description of Artificial Sequence: Target Sequence/siNA antisense region
acgagguugcgaccgcucg

SEQ ID NO: 1317 - RNA, 19 nt, Artificial Sequence
  Description of Artificial Sequence: Target Sequence/siNA antisense region
uggaauaguaggcaaggcc

SEQ ID NO: 1318 - RNA, 19 nt, Artificial Sequence
  Description of Artificial Sequence: Target Sequence/siNA antisense region
cccgucacguaguggaaau

SEQ ID NO: 1319 - RNA, 19 nt, Artificial Sequence
  Description of Artificial Sequence: Target Sequence/siNA antisense region
gcccgggaacuugacgucc

SEQ ID NO: 1320 - RNA, 19 nt, Artificial Sequence
  Description of Artificial Sequence: Target Sequence/siNA antisense region
agcccgcgucauagcacuc

SEQ ID NO: 1321 - RNA, 19 nt, Artificial Sequence
  Description of Artificial Sequence: Target Sequence/siNA antisense region
cgcccgggaacuugacguc

SEQ ID NO: 1322 - RNA, 19 nt, Artificial Sequence
  Description of Artificial Sequence: Target Sequence/siNA antisense region
gaccaagacccgucgcuga

SEQ ID NO: 1323 - RNA, 19 nt, Artificial Sequence
  Description of Artificial Sequence: Target Sequence/siNA antisense region
ccaccgcccgggaacuuga

SEQ ID NO: 1324 - RNA, 19 nt, Artificial Sequence
  Description of Artificial Sequence: Target Sequence/siNA antisense region
uucgccuucaucuccuuga

SEQ ID NO: 1325 - RNA, 19 nt, Artificial Sequence
  Description of Artificial Sequence: Target Sequence/siNA antisense region
ggcgagccuuggggauagg

SEQ ID NO: 1326 - RNA, 19 nt, Artificial Sequence
  Description of Artificial Sequence: Target Sequence/siNA antisense region
ugaucugagguaggucaag

SEQ ID NO: 1327 - RNA, 19 nt, Artificial Sequence
  Description of Artificial Sequence: Target Sequence/siNA antisense region
gcccgucacguaguggaaa

SEQ ID NO: 1328 - RNA, 19 nt, Artificial Sequence
  Description of Artificial Sequence: Target Sequence/siNA antisense region
cagcccgcgucauagcacu

SEQ ID NO: 1329 - RNA, 19 nt, Artificial Sequence
  Description of Artificial Sequence: Target Sequence/siNA antisense region
ccgcccgggaacuugacgu

SEQ ID NO: 1330 - RNA, 19 nt, Artificial Sequence
  Description of Artificial Sequence: Target Sequence/siNA antisense region
cuggcccgaugucuccaga

SEQ ID NO: 1331 - RNA, 19 nt, Artificial Sequence
  Description of Artificial Sequence: Target Sequence/siNA antisense region
uuccacaugugcuucgccc

SEQ ID NO: 1332 - RNA, 19 nt, Artificial Sequence
  Description of Artificial Sequence: Target Sequence/siNA antisense region
augaucugagguaggucaa

SEQ ID NO: 1333 - RNA, 19 nt, Artificial Sequence
  Description of Artificial Sequence: Target Sequence/siNA antisense region
uccagccgucuccgcuugg

SEQ ID NO: 1334 - RNA, 19 nt, Artificial Sequence
  Description of Artificial Sequence: Target Sequence/siNA antisense region
ccagccgucuccgcuuggu

SEQ ID NO: 1335 - RNA, 19 nt, Artificial Sequence
  Description of Artificial Sequence: Target Sequence/siNA antisense region
cugaggcaugaagccaccc

SEQ ID NO: 1336 - RNA, 19 nt, Artificial Sequence
  Description of Artificial Sequence: Target Sequence/siNA antisense region
caccgcccgggaacuugac

SEQ ID NO: 1337 - RNA, 19 nt, Artificial Sequence
  Description of Artificial Sequence: Target Sequence/siNA antisense region
ucgccuucaucuccuugag

SEQ ID NO: 1338 - RNA, 19 nt, Artificial Sequence
  Description of Artificial Sequence: Target Sequence/siNA antisense region
cagccgucuccgcuugguc

SEQ ID NO: 1339 - RNA, 19 nt, Artificial Sequence
  Description of Artificial Sequence: Target Sequence/siNA antisense region
ugguugagcccgaccugga

SEQ ID NO: 1340 - RNA, 19 nt, Artificial Sequence
  Description of Artificial Sequence: Target Sequence/siNA antisense region
gaggaagauagagaaagag

SEQ ID NO: 1341 - RNA, 19 nt, Artificial Sequence
  Description of Artificial Sequence: Target Sequence/siNA antisense region
uggcccgaugucuccagac

SEQ ID NO: 1342 - RNA, 19 nt, Artificial Sequence
  Description of Artificial Sequence: Target Sequence/siNA antisense region
ucgggggccaagucacaac

SEQ ID NO: 1343 - RNA, 19 nt, Artificial Sequence
  Description of Artificial Sequence: Target Sequence/siNA antisense region
uuggacuggagccaggucu

SEQ ID NO: 1344 - RNA, 19 nt, Artificial Sequence
  Description of Artificial Sequence: Target Sequence/siNA antisense region
ccauggaauaguaggcaag

SEQ ID NO: 1345 - RNA, 19 nt, Artificial Sequence
  Description of Artificial Sequence: Target Sequence/siNA antisense region
uagagaaagagcaaccggg

SEQ ID NO: 1346 - RNA, 19 nt, Artificial Sequence
  Description of Artificial Sequence: Target Sequence/siNA antisense region
aagaggaagauagagaaag

SEQ ID NO: 1347 - RNA, 19 nt, Artificial Sequence
  Description of Artificial Sequence: Target Sequence/siNA antisense region
ugaggcaugaagccacccu

SEQ ID NO: 1348 - RNA, 19 nt, Artificial Sequence
  Description of Artificial Sequence: Target Sequence/siNA antisense region
uggacuggagccaggucuu

SEQ ID NO: 1349 - RNA, 19 nt, Artificial Sequence
  Description of Artificial Sequence: Target Sequence/siNA antisense region
auagagaaagagcaaccgg

SEQ ID NO: 1350 - RNA, 19 nt, Artificial Sequence
  Description of Artificial Sequence: Target Sequence/siNA antisense region
gauagagaaagagcaaccg

SEQ ID NO: 1351 - RNA, 19 nt, Artificial Sequence
  Description of Artificial Sequence: Target Sequence/siNA antisense region
acguaguggaaauccccca

SEQ ID NO: 1352 - RNA, 19 nt, Artificial Sequence
  Description of Artificial Sequence: Target Sequence/siNA antisense region
gagcagucguucgugacau

SEQ ID NO: 1353 - RNA, 19 nt, Artificial Sequence
  Description of Artificial Sequence: Target Sequence/siNA antisense region
guggggccccaacuaggcc

SEQ ID NO: 1354 - RNA, 19 nt, Artificial Sequence
  Description of Artificial Sequence: Target Sequence/siNA antisense region
gccgucuccgcuuggucca

SEQ ID NO: 1355 - RNA, 19 nt, Artificial Sequence
  Description of Artificial Sequence: Target Sequence/siNA antisense region
gguugagcccgaccuggaa

SEQ ID NO: 1356 - RNA, 19 nt, Artificial Sequence
  Description of Artificial Sequence: Target Sequence/siNA antisense region
accaggaacucgacccgcu

SEQ ID NO: 1357 - RNA, 19 nt, Artificial Sequence
  Description of Artificial Sequence: Target Sequence/siNA antisense region
cuucgccuucaucuccuug

SEQ ID NO: 1358 - RNA, 19 nt, Artificial Sequence
  Description of Artificial Sequence: Target Sequence/siNA antisense region
agcagucguucgugacaug

SEQ ID NO: 1359 - RNA, 19 nt, Artificial Sequence
  Description of Artificial Sequence: Target Sequence/siNA antisense region
ccaggaacucgacccgcug

SEQ ID NO: 1360 - RNA, 19 nt, Artificial Sequence
  Description of Artificial Sequence: Target Sequence/siNA antisense region
ugcccgucacguaguggaa

SEQ ID NO: 1361 - RNA, 19 nt, Artificial Sequence
  Description of Artificial Sequence: Target Sequence/siNA antisense region
gaggcaugaagccacccua

SEQ ID NO: 1362 - RNA, 19 nt, Artificial Sequence
  Description of Artificial Sequence: Target Sequence/siNA antisense region
agcaucgugcaguccugga

SEQ ID NO: 1363 - RNA, 19 nt, Artificial Sequence
  Description of Artificial Sequence: Target Sequence/siNA antisense region
augcccgucacguagugga

SEQ ID NO: 1364 - RNA, 19 nt, Artificial Sequence
  Description of Artificial Sequence: Target Sequence/siNA antisense region
ggcaugaagccacccuauu

SEQ ID NO: 1365 - RNA, 19 nt, Artificial Sequence
  Description of Artificial Sequence: Target Sequence/siNA antisense region
ucauagccuccgugaagac

SEQ ID NO: 1366 - RNA, 19 nt, Artificial Sequence
  Description of Artificial Sequence: Target Sequence/siNA antisense region
aggcaugaagccacccuau

SEQ ID NO: 1367 - RNA, 19 nt, Artificial Sequence
  Description of Artificial Sequence: Target Sequence/siNA antisense region
gucauagccuccgugaaga

SEQ ID NO: 1368 - RNA, 19 nt, Artificial Sequence
  Description of Artificial Sequence: Target Sequence/siNA antisense region
cccaaguuuccugaggcau

SEQ ID NO: 1369 - RNA, 19 nt, Artificial Sequence
  Description of Artificial Sequence: Target Sequence/siNA antisense region
uccuugagcacgucccggu

SEQ ID NO: 1370 - RNA, 19 nt, Artificial Sequence
  Description of Artificial Sequence: Target Sequence/siNA antisense region
ucauccacugcacagcccc

SEQ ID NO: 1371 - RNA, 19 nt, Artificial Sequence
  Description of Artificial Sequence: Target Sequence/siNA antisense region
ucgugcaguccuggagcuu

SEQ ID NO: 1372 - RNA, 19 nt, Artificial Sequence
  Description of Artificial Sequence: Target Sequence/siNA antisense region
caucgugcaguccuggagc

SEQ ID NO: 1373 - RNA, 19 nt, Artificial Sequence
  Description of Artificial Sequence: Target Sequence/siNA antisense region
ccuugagcacgucccggua

SEQ ID NO: 1374 - RNA, 19 nt, Artificial Sequence
  Description of Artificial Sequence: Target Sequence/siNA antisense region
uucauccacugcacagccc

SEQ ID NO: 1375 - RNA, 19 nt, Artificial Sequence
  Description of Artificial Sequence: Target Sequence/siNA antisense region
accgcccgggaacuugacg

SEQ ID NO: 1376 - RNA, 19 nt, Artificial Sequence
  Description of Artificial Sequence: Target Sequence/siNA antisense region
caugaagccacccuauuga

SEQ ID NO: 1377 - RNA, 19 nt, Artificial Sequence
  Description of Artificial Sequence: Target Sequence/siNA antisense region
cauagccuccgugaagacu

SEQ ID NO: 1378 - RNA, 19 nt, Artificial Sequence
  Description of Artificial Sequence: Target Sequence/siNA antisense region
agccgucuccgcuuggucc

SEQ ID NO: 1379 - RNA, 19 nt, Artificial Sequence
  Description of Artificial Sequence: Target Sequence/siNA antisense region
aggagcuuggacuggagcc

SEQ ID NO: 1380 - RNA, 19 nt, Artificial Sequence
  Description of Artificial Sequence: Target Sequence/siNA antisense region
guucauccacugcacagcc

SEQ ID NO: 1381 - RNA, 19 nt, Artificial Sequence
  Description of Artificial Sequence: Target Sequence/siNA antisense region
gcaucgugcaguccuggag

SEQ ID NO: 1382 - RNA, 19 nt, Artificial Sequence
  Description of Artificial Sequence: Target Sequence/siNA antisense region
auagccuccgugaagacuc

SEQ ID NO: 1383 - RNA, 19 nt, Artificial Sequence
  Description of Artificial Sequence: Target Sequence/siNA antisense region
ggagcuuggacuggagcca

SEQ ID NO: 1384 - RNA, 19 nt, Artificial Sequence
  Description of Artificial Sequence: Target Sequence/siNA antisense region
ucacguaguggaaaucccc

SEQ ID NO: 1385 - RNA, 19 nt, Artificial Sequence
  Description of Artificial Sequence: Target Sequence/siNA antisense region
ccaaguuuccugaggcaug

SEQ ID NO: 1386 - RNA, 19 nt, Artificial Sequence
  Description of Artificial Sequence: Target Sequence/siNA antisense region
augaagccacccuauugau

SEQ ID NO: 1387 - RNA, 19 nt, Artificial Sequence
  Description of Artificial Sequence: Target Sequence/siNA antisense region
aauaguaggcaaggcccgc

SEQ ID NO: 1388 - RNA, 19 nt, Artificial Sequence
  Description of Artificial Sequence: Target Sequence/siNA antisense region
cuccuugagcacgucccgg

SEQ ID NO: 1389 - RNA, 19 nt, Artificial Sequence
  Description of Artificial Sequence: Target Sequence/siNA antisense region
gcccaguuccccaccaugg

SEQ ID NO: 1390 - RNA, 19 nt, Artificial Sequence
  Description of Artificial Sequence: Target Sequence/siNA antisense region
gcaugaagccacccuauug

SEQ ID NO: 1391 - RNA, 19 nt, Artificial Sequence
  Description of Artificial Sequence: Target Sequence/siNA antisense region
aucgugcaguccuggagcu

SEQ ID NO: 1392 - RNA, 19 nt, Artificial Sequence
  Description of Artificial Sequence: Target Sequence/siNA antisense region
gaauaguaggcaaggcccg

SEQ ID NO: 1393 - RNA, 23 nt, Artificial Sequence
  Description of Artificial Sequence: Target Sequence/siNA sense region
gguccuuucuuggaucaacccgc

SEQ ID NO: 1394 - RNA, 23 nt, Artificial Sequence
  Description of Artificial Sequence: Target Sequence/siNA sense region
ugccccgggaggucucguagacc

SEQ ID NO: 1395 - RNA, 23 nt, Artificial Sequence
  Description of Artificial Sequence: Target Sequence/siNA sense region
ugcggaaccggugaguacaccgg

SEQ ID NO: 1396 - RNA, 23 nt, Artificial Sequence
  Description of Artificial Sequence: Target Sequence/siNA sense region
gcggaaccggugaguacaccgga

SEQ ID NO: 1397 - RNA, 23 nt, Artificial Sequence
  Description of Artificial Sequence: Target Sequence/siNA sense region
ccuugugguacugccugauaggg

SEQ ID NO: 1398 - RNA, 23 nt, Artificial Sequence
  Description of Artificial Sequence: Target Sequence/siNA sense region
cuugugguacugccugauagggu

SEQ ID NO: 1399 - RNA, 23 nt, Artificial Sequence
  Description of Artificial Sequence: Target Sequence/siNA sense region
uugugguacugccugauagggug

SEQ ID NO: 1400 - RNA, 23 nt, Artificial Sequence
  Description of Artificial Sequence: Target Sequence/siNA sense region
gugccccgggaggucucguagac

SEQ ID NO: 1401 - RNA, 23 nt, Artificial Sequence
  Description of Artificial Sequence: Target Sequence/siNA sense region
auaguggucugcggaaccgguga

SEQ ID NO: 1402 - RNA, 23 nt, Artificial Sequence
  Description of Artificial Sequence: Target Sequence/siNA sense region
gucugcggaaccggugaguacac

SEQ ID NO: 1403 - RNA, 23 nt, Artificial Sequence
  Description of Artificial Sequence: Target Sequence/siNA sense region
gccuugugguacugccugauagg

SEQ ID NO: 1404 - RNA, 23 nt, Artificial Sequence
  Description of Artificial Sequence: Target Sequence/siNA sense region
ugugguacugccugauagggugc

SEQ ID NO: 1405 - RNA, 23 nt, Artificial Sequence
  Description of Artificial Sequence: Target Sequence/siNA sense region
gugguacugccugauagggugcu

SEQ ID NO: 1406 - RNA, 23 nt, Artificial Sequence
  Description of Artificial Sequence: Target Sequence/siNA sense region
ugguacugccugauagggugcuu

SEQ ID NO: 1407 - RNA, 23 nt, Artificial Sequence
  Description of Artificial Sequence: Target Sequence/siNA sense region
gguacugccugauagggugcuug

SEQ ID NO: 1408 - RNA, 23 nt, Artificial Sequence
  Description of Artificial Sequence: Target Sequence/siNA sense region
uacugccugauagggugcuugcg

SEQ ID NO: 1409 - RNA, 23 nt, Artificial Sequence
  Description of Artificial Sequence: Target Sequence/siNA sense region
acugccugauagggugcuugcga

SEQ ID NO: 1410 - RNA, 23 nt, Artificial Sequence
  Description of Artificial Sequence: Target Sequence/siNA sense region
ugccugauagggugcuugcgagu

SEQ ID NO: 1411 - RNA, 23 nt, Artificial Sequence
  Description of Artificial Sequence: Target Sequence/siNA sense region
cugauagggugcuugcgagugcc

SEQ ID NO: 1412 - RNA, 23 nt, Artificial Sequence
  Description of Artificial Sequence: Target Sequence/siNA sense region
aaaggccuugugguacugccuga

SEQ ID NO: 1413 - RNA, 23 nt, Artificial Sequence
  Description of Artificial Sequence: Target Sequence/siNA sense region
ggguccuuucuuggaucaacccg

SEQ ID NO: 1414 - RNA, 23 nt, Artificial Sequence
  Description of Artificial Sequence: Target Sequence/siNA sense region
cggguccuuucuuggaucaaccc

SEQ ID NO: 1415 - RNA, 23 nt, Artificial Sequence
  Description of Artificial Sequence: Target Sequence/siNA sense region
gaccggguccuuucuuggaucaa

SEQ ID NO: 1416 - RNA, 23 nt, Artificial Sequence
  Description of Artificial Sequence: Target Sequence/siNA sense region
gccccgggaggucucguagaccg

SEQ ID NO: 1417 - RNA, 23 nt, Artificial Sequence
  Description of Artificial Sequence: Target Sequence/siNA sense region
ccccgggaggucucguagaccgu

SEQ ID NO: 1418 - RNA, 23 nt, Artificial Sequence
  Description of Artificial Sequence: Target Sequence/siNA sense region
cccgggaggucucguagaccgug

SEQ ID NO: 1419 - RNA, 23 nt, Artificial Sequence
  Description of Artificial Sequence: Target Sequence/siNA sense region
ccgggaggucucguagaccgugc

SEQ ID NO: 1420 - RNA, 23 nt, Artificial Sequence
  Description of Artificial Sequence: Target Sequence/siNA sense region
ucccgggagagccauaguggucu

SEQ ID NO: 1421 - RNA, 23 nt, Artificial Sequence
  Description of Artificial Sequence: Target Sequence/siNA sense region
cccgggagagccauaguggucug

SEQ ID NO: 1422 - RNA, 23 nt, Artificial Sequence
  Description of Artificial Sequence: Target Sequence/siNA sense region
ccgggagagccauaguggucugc

SEQ ID NO: 1423 - RNA, 23 nt, Artificial Sequence
  Description of Artificial Sequence: Target Sequence/siNA sense region
uaguggucugcggaaccggugag

SEQ ID NO: 1424 - RNA, 23 nt, Artificial Sequence
  Description of Artificial Sequence: Target Sequence/siNA sense region
aguggucugcggaaccggugagu

SEQ ID NO: 1425 - RNA, 23 nt, Artificial Sequence
  Description of Artificial Sequence: Target Sequence/siNA sense region
guggucugcggaaccggugagua

SEQ ID NO: 1426 - RNA, 23 nt, Artificial Sequence
  Description of Artificial Sequence: Target Sequence/siNA sense region
uggucugcggaaccggugaguac

SEQ ID NO: 1427 - RNA, 23 nt, Artificial Sequence
  Description of Artificial Sequence: Target Sequence/siNA sense region
ggucugcggaaccggugaguaca

SEQ ID NO: 1428 - RNA, 23 nt, Artificial Sequence
  Description of Artificial Sequence: Target Sequence/siNA sense region
ucugcggaaccggugaguacacc

SEQ ID NO: 1429 - RNA, 23 nt, Artificial Sequence
  Description of Artificial Sequence: Target Sequence/siNA sense region
cugcggaaccggugaguacaccg

SEQ ID NO: 1430 - RNA, 23 nt, Artificial Sequence
  Description of Artificial Sequence: Target Sequence/siNA sense region
cggaaccggugaguacaccggaa

SEQ ID NO: 1431 - RNA, 23 nt, Artificial Sequence
  Description of Artificial Sequence: Target Sequence/siNA sense region
ggaaccggugaguacaccggaau

SEQ ID NO: 1432 - RNA, 23 nt, Artificial Sequence
  Description of Artificial Sequence: Target Sequence/siNA sense region
gaaccggugaguacaccggaauu

SEQ ID NO: 1433 - RNA, 23 nt, Artificial Sequence
  Description of Artificial Sequence: Target Sequence/siNA sense region
aaccggugaguacaccggaauug

SEQ ID NO: 1434 - RNA, 23 nt, Artificial Sequence
  Description of Artificial Sequence: Target Sequence/siNA sense region
ucgcgaaaggccuugugguacug

SEQ ID NO: 1435 - RNA, 23 nt, Artificial Sequence
  Description of Artificial Sequence: Target Sequence/siNA sense region
cgcgaaaggccuugugguacugc

SEQ ID NO: 1436 - RNA, 23 nt, Artificial Sequence
  Description of Artificial Sequence: Target Sequence/siNA sense region
gcgaaaggccuugugguacugcc

SEQ ID NO: 1437 - RNA, 23 nt, Artificial Sequence
  Description of Artificial Sequence: Target Sequence/siNA sense region
cgaaaggccuugugguacugccu

SEQ ID NO: 1438 - RNA, 23 nt, Artificial Sequence
  Description of Artificial Sequence: Target Sequence/siNA sense region
gaaaggccuugugguacugccug

SEQ ID NO: 1439 - RNA, 23 nt, Artificial Sequence
  Description of Artificial Sequence: Target Sequence/siNA sense region
aaggccuugugguacugccugau

SEQ ID NO: 1440 - RNA, 23 nt, Artificial Sequence
  Description of Artificial Sequence: Target Sequence/siNA sense region
aggccuugugguacugccugaua

SEQ ID NO: 1441 - RNA, 23 nt, Artificial Sequence
  Description of Artificial Sequence: Target Sequence/siNA sense region
ggccuugugguacugccugauag

SEQ ID NO: 1442 - RNA, 23 nt, Artificial Sequence
  Description of Artificial Sequence: Target Sequence/siNA sense region
guacugccugauagggugcuugc

SEQ ID NO: 1443 - RNA, 23 nt, Artificial Sequence
  Description of Artificial Sequence: Target Sequence/siNA sense region
cugccugauagggugcuugcgag

SEQ ID NO: 1444 - RNA, 23 nt, Artificial Sequence
  Description of Artificial Sequence: Target Sequence/siNA sense region
gccugauagggugcuugcgagug

SEQ ID NO: 1445 - RNA, 23 nt, Artificial Sequence
  Description of Artificial Sequence: Target Sequence/siNA sense region
ccugauagggugcuugcgagugc

SEQ ID NO: 1446 - RNA, 23 nt, Artificial Sequence
  Description of Artificial Sequence: Target Sequence/siNA sense region
ugauagggugcuugcgagugccc

SEQ ID NO: 1447 - RNA, 23 nt, Artificial Sequence
  Description of Artificial Sequence: Target Sequence/siNA sense region
gauagggugcuugcgagugcccc

SEQ ID NO: 1448 - RNA, 23 nt, Artificial Sequence
  Description of Artificial Sequence: Target Sequence/siNA sense region
uagggugcuugcgagugccccgg

SEQ ID NO: 1449 - RNA, 23 nt, Artificial Sequence
  Description of Artificial Sequence: Target Sequence/siNA sense region
agggugcuugcgagugccccggg

SEQ ID NO: 1450 - RNA, 23 nt, Artificial Sequence
  Description of Artificial Sequence: Target Sequence/siNA sense region
gugcuugcgagugccccgggagg

SEQ ID NO: 1451 - RNA, 23 nt, Artificial Sequence
  Description of Artificial Sequence: Target Sequence/siNA sense region
ugcuugcgagugccccgggaggu

SEQ ID NO: 1452 - RNA, 23 nt, Artificial Sequence
  Description of Artificial Sequence: Target Sequence/siNA sense region
gcuugcgagugccccgggagguc

SEQ ID NO: 1453 - RNA, 23 nt, Artificial Sequence
  Description of Artificial Sequence: Target Sequence/siNA sense region
cuugcgagugccccgggaggucu

SEQ ID NO: 1454 - RNA, 23 nt, Artificial Sequence
  Description of Artificial Sequence: Target Sequence/siNA sense region
uugcgagugccccgggaggucuc

SEQ ID NO: 1455 - RNA, 23 nt, Artificial Sequence
  Description of Artificial Sequence: Target Sequence/siNA sense region
ugcgagugccccgggaggucucg

SEQ ID NO: 1456 - RNA, 23 nt, Artificial Sequence
  Description of Artificial Sequence: Target Sequence/siNA sense region
gcgagugccccgggaggucucgu

SEQ ID NO: 1457 - RNA, 23 nt, Artificial Sequence
  Description of Artificial Sequence: Target Sequence/siNA sense region
gagugccccgggaggucucguag

SEQ ID NO: 1458 - RNA, 23 nt, Artificial Sequence
  Description of Artificial Sequence: Target Sequence/siNA sense region
agugccccgggaggucucguaga

SEQ ID NO: 1459 - RNA, 23 nt, Artificial Sequence
  Description of Artificial Sequence: Target Sequence/siNA sense region
cgggaggucucguagaccgugca

SEQ ID NO: 1460 - RNA, 23 nt, Artificial Sequence
  Description of Artificial Sequence: Target Sequence/siNA sense region
uagccauggcguuaguaugagug

SEQ ID NO: 1461 - RNA, 23 nt, Artificial Sequence
  Description of Artificial Sequence: Target Sequence/siNA sense region
cccucccgggagagccauagugg

SEQ ID NO: 1462 - RNA, 46 nt, Artificial Sequence
  Description of Artificial Sequence: Target Sequence/siNA sense region
ccccgggaggucucguagaccguucgcgaaaggccuugugguacug

SEQ ID NO: 1463 - RNA, 46 nt, Artificial Sequence
  Description of Artificial Sequence: Target Sequence/siNA sense region
ccccgggaggucucguagaccguugauagggugcuugcgagugccc

SEQ ID NO: 1464 - RNA, 46 nt, Artificial Sequence
  Description of Artificial Sequence: Target Sequence/siNA sense region
ugauagggugcuugcgagugcccucgcgaaaggccuugugguacug

SEQ ID NO: 1465 - RNA, 46 nt, Artificial Sequence
  Description of Artificial Sequence: Target Sequence/siNA sense region
ccccgggaggucucguagaccgugccugauagggugcuugcgagug

SEQ ID NO: 1466 - RNA, 46 nt, Artificial Sequence
  Description of Artificial Sequence: Target Sequence/siNA sense region
gccugauagggugcuugcgagugucgcgaaaggccuugugguacug

SEQ ID NO: 1467 - RNA, 21 nt, Artificial Sequence
  Description of Artificial Sequence: Target Sequence/siNA STRAND region
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
gguccuuucuuggaucaaccc

SEQ ID NO: 1468 - RNA, 21 nt, Artificial Sequence
  Description of Artificial Sequence: Target Sequence/siNA STRAND region
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
ggguugauccaagaaaggacc

SEQ ID NO: 1469 - RNA, 21 nt, Artificial Sequence
  Description of Artificial Sequence: Target Sequence/siNA STRAND region
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
cccaacuagguucuuuccugg

SEQ ID NO: 1470 - RNA, 21 nt, Artificial Sequence
  Description of Artificial Sequence: Target Sequence/siNA STRAND region
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
ccaggaaagaaccuaguuggg

SEQ ID NO: 1471 - RNA, 23 nt, Artificial Sequence
  Description of Artificial Sequence: Target Sequence/siNA STRAND region
gguccuuucuuggaucaacccuu

SEQ ID NO: 1472 - RNA, 23 nt, Artificial Sequence
  Description of Artificial Sequence: Target Sequence/siNA STRAND region
ggguugauccaagaaaggaccuu

SEQ ID NO: 1473 - RNA, 23 nt, Artificial Sequence
  Description of Artificial Sequence: Target Sequence/siNA STRAND region
  misc_feature (1)..(1): 5'-3 attached terminal deoxyabasic moiety, inverted abasic, inverted nucleotide or other terminal cap that is optionally present
  misc_feature (23)..(23): 3'-3 attached terminal deoxyabasic moiety, inverted abasic, inverted nucleotide or other terminal cap that is optionally present
gguccuuucuuggaucaacccuu

SEQ ID NO: 1474 - RNA, 23 nt, Artificial Sequence
  Description of Artificial Sequence: Target Sequence/siNA STRAND region
  misc_feature (1)..(1): 5'-3 attached terminal deoxyabasic moiety, inverted abasic, inverted nucleotide or other terminal cap that is optionally present
  misc_feature (23)..(23): 3'-3 attached terminal deoxyabasic moiety, inverted abasic, inverted nucleotide or other terminal cap that is optionally present
ggguugauccaagaaaggaccuu

SEQ ID NO: 1475 - DNA, 21 bp, Artificial Sequence
  Description of Artificial Sequence: Target Sequence/siNA sense region (stab00)
  misc_feature (1)..(19): ribonucleotide unmodified or modified as described for this sequence
ccccgggaggucucguagatt

SEQ ID NO: 1476 - DNA, 21 bp, Artificial Sequence
  Description of Artificial Sequence: Target Sequence/siNA sense region (stab00)
  misc_feature (1)..(19): ribonucleotide unmodified or modified as described for this sequence
cggaaccggugaguacacctt

SEQ ID NO: 1477 - DNA, 21 bp, Artificial Sequence
  Description of Artificial Sequence: Target Sequence/siNA sense region (stab00)
  misc_feature (1)..(19): ribonucleotide unmodified or modified as described for this sequence
gccccgggaggucucguagtt

SEQ ID NO: 1478 - DNA, 21 bp, Artificial Sequence
  Description of Artificial Sequence: Target Sequence/siNA sense region (stab00)
  misc_feature (1)..(19): ribonucleotide unmodified or modified as described for this sequence
ggaaccggugaguacaccgtt

SEQ ID NO: 1479 - DNA, 21 bp, Artificial Sequence
  Description of Artificial Sequence: Target Sequence/siNA sense region (stab00)
  misc_feature (1)..(19): ribonucleotide unmodified or modified as described for this sequence
gugguacugccugauagggtt

SEQ ID NO: 1480 - DNA, 21 bp, Artificial Sequence
  Description of Artificial Sequence: Target Sequence/siNA sense region (stab00)
  misc_feature (1)..(19): ribonucleotide unmodified or modified as described for this sequence
ugugguacugccugauaggtt

SEQ ID NO: 1481 - DNA, 21 bp, Artificial Sequence
  Description of Artificial Sequence: Target Sequence/siNA sense region (stab00)
  misc_feature (1)..(19): ribonucleotide unmodified or modified as described for this sequence
uugugguacugccugauagtt

SEQ ID NO: 1482 - DNA, 21 bp, Artificial Sequence
  Description of Artificial Sequence: Target Sequence/siNA antisense region (stab00as)
  misc_feature (1)..(19): ribonucleotide unmodified or modified as described for this sequence
ucuacgagaccucccggggtt

SEQ ID NO: 1483 - DNA, 21 bp, Artificial Sequence
  Description of Artificial Sequence: Target Sequence/siNA antisense region (stab00as)
  misc_feature (1)..(19): ribonucleotide unmodified or modified as described for this sequence
gguguacucaccgguuccgtt

SEQ ID NO: 1484 - DNA, 21 bp, Artificial Sequence
  Description of Artificial Sequence: Target Sequence/siNA antisense region (stab00as)
  misc_feature (1)..(19): ribonucleotide unmodified or modified as described for this sequence
cuacgagaccucccggggctt

SEQ ID NO: 1485 - DNA, 21 bp, Artificial Sequence
  Description of Artificial Sequence: Target Sequence/siNA antisense region (stab00as)
  misc_feature (1)..(19): ribonucleotide unmodified or modified as described for this sequence
cgguguacucaccgguucctt

SEQ ID NO: 1486 - DNA, 21 bp, Artificial Sequence
  Description of Artificial Sequence: Target Sequence/siNA antisense region (stab00as)
  misc_feature (1)..(19): ribonucleotide unmodified or modified as described for this sequence
cccuaucaggcaguaccactt

SEQ ID NO: 1487 - DNA, 21 bp, Artificial Sequence
  Description of Artificial Sequence: Target Sequence/siNA antisense region (stab00as)
  misc_feature (1)..(19): ribonucleotide unmodified or modified as described for this sequence
ccuaucaggcaguaccacatt

SEQ ID NO: 1488 - DNA, 21 bp, Artificial Sequence
  Description of Artificial Sequence: Target Sequence/siNA antisense region (stab00as)
  misc_feature (1)..(19): ribonucleotide unmodified or modified as described for this sequence
cuaucaggcaguaccacaatt

SEQ ID NO: 1489 - DNA, 21 bp, Artificial Sequence
  Description of Artificial Sequence: Target Sequence/siNA sense region
  misc_feature (3)..(21): ribonucleotide unmodified or modified as described for this sequence
ttagaugcucuggagggcccc

SEQ ID NO: 1490 - DNA, 21 bp, Artificial Sequence
  Description of Artificial Sequence: Target Sequence/siNA sense region
  misc_feature (3)..(21): ribonucleotide unmodified or modified as described for this sequence
ttccacaugaguggccaaggc

SEQ ID NO: 1491 - DNA, 21 bp, Artificial Sequence
  Description of Artificial Sequence: Target Sequence/siNA sense region
  misc_feature (3)..(21): ribonucleotide unmodified or modified as described for this sequence
ttgaugcucuggagggccccg

SEQ ID NO: 1492 - DNA, 21 bp, Artificial Sequence
  Description of Artificial Sequence: Target Sequence/siNA sense region
  misc_feature (3)..(21): ribonucleotide unmodified or modified as described for this sequence
ttgccacaugaguggccaagg

SEQ ID NO: 1493 - DNA, 21 bp, Artificial Sequence
  Description of Artificial Sequence: Target Sequence/siNA sense region
  misc_feature (3)..(21): ribonucleotide unmodified or modified as described for this sequence
ttgggauaguccgucauggug

SEQ ID NO: 1494 - DNA, 21 bp, Artificial Sequence
  Description of Artificial Sequence: Target Sequence/siNA sense region
  misc_feature (3)..(21): ribonucleotide unmodified or modified as described for this sequence
ttggauaguccgucauggugu

SEQ ID NO: 1495 - DNA, 21 bp, Artificial Sequence
  Description of Artificial Sequence: Target Sequence/siNA sense region
  misc_feature (3)..(21): ribonucleotide unmodified or modified as described for this sequence
ttgauaguccgucaugguguu

SEQ ID NO: 1496 - DNA, 21 bp, Artificial Sequence
  Description of Artificial Sequence: Target Sequence/siNA antisense region
  misc_feature (3)..(21): ribonucleotide unmodified or modified as described for this sequence
ttggggcccuccagagcaucu

SEQ ID NO: 1497 - DNA, 21 bp, Artificial Sequence
  Description of Artificial Sequence: Target Sequence/siNA antisense region
  misc_feature (3)..(21): ribonucleotide unmodified or modified as described for this sequence
ttgccuuggccacucaugugg

SEQ ID NO: 1498 - DNA, 21 bp, Artificial Sequence
  Description of Artificial Sequence: Target Sequence/siNA antisense region
  misc_feature (3)..(21): ribonucleotide unmodified or modified as described for this sequence
ttcggggcccuccagagcauc

SEQ ID NO: 1499 - DNA, 21 bp, Artificial Sequence
  Description of Artificial Sequence: Target Sequence/siNA antisense region
  misc_feature (3)..(21): ribonucleotide unmodified or modified as described for this sequence
ttccuuggccacucauguggc

SEQ ID NO: 1500 - DNA, 21 bp, Artificial Sequence
  Description of Artificial Sequence: Target Sequence/siNA antisense region
  misc_feature (3)..(21): ribonucleotide unmodified or modified as described for this sequence
ttcaccaugacggacuauccc

SEQ ID NO: 1501 - DNA, 21 bp, Artificial Sequence
  Description of Artificial Sequence: Target Sequence/siNA antisense region
  misc_feature (3)..(21): ribonucleotide unmodified or modified as described for this sequence
ttacaccaugacggacuaucc

SEQ ID NO: 1502 - DNA, 21 bp, Artificial Sequence
  Description of Artificial Sequence: Target Sequence/siNA antisense region
  misc_feature (3)..(21): ribonucleotide unmodified or modified as described for this sequence
ttaacaccaugacggacuauc

SEQ ID NO: 1503 - RNA, 21 nt, Artificial Sequence
  Description of Artificial Sequence: Target Sequence/siNA sense region
cggaaccggugaguacaccgg

SEQ ID NO: 1504 - RNA, 21 nt, Artificial Sequence
  Description of Artificial Sequence: Target Sequence/siNA sense region
ggaaccggugaguacaccgga

SEQ ID NO: 1505 - RNA, 21 nt, Artificial Sequence
  Description of Artificial Sequence: Target Sequence/siNA sense region
uugugguacugccugauaggg

SEQ ID NO: 1506 - RNA, 21 nt, Artificial Sequence
  Description of Artificial Sequence: Target Sequence/siNA sense region
ugugguacugccugauagggu

SEQ ID NO: 1507 - RNA, 21 nt, Artificial Sequence
  Description of Artificial Sequence: Target Sequence/siNA sense region
gugguacugccugauagggug

SEQ ID NO: 1508 - RNA, 21 nt, Artificial Sequence
  Description of Artificial Sequence: Target Sequence/siNA sense region
gccccgggaggucucguagac

SEQ ID NO: 1509 - RNA, 21 nt, Artificial Sequence
  Description of Artificial Sequence: Target Sequence/siNA sense region
ccccgggaggucucguagacc

SEQ ID NO: 1510 - RNA, 21 nt, Artificial Sequence
  Description of Artificial Sequence: Target Sequence/siNA antisense region
gguguacucaccgguuccgca

SEQ ID NO: 1511 - RNA, 21 nt, Artificial Sequence
  Description of Artificial Sequence: Target Sequence/siNA antisense region
cgguguacucaccgguuccgc

SEQ ID NO: 1512 - RNA, 21 nt, Artificial Sequence
  Description of Artificial Sequence: Target Sequence/siNA antisense region
cuaucaggcaguaccacaagg

SEQ ID NO: 1513 - RNA, 21 nt, Artificial Sequence
  Description of Artificial Sequence: Target Sequence/siNA antisense region
ccuaucaggcaguaccacaag

SEQ ID NO: 1514 - RNA, 21 nt, Artificial Sequence
  Description of Artificial Sequence: Target Sequence/siNA antisense region
cccuaucaggcaguaccacaa

SEQ ID NO: 1515 - RNA, 21 nt, Artificial Sequence
  Description of Artificial Sequence: Target Sequence/siNA antisense region
cuacgagaccucccggggcac

SEQ ID NO: 1516 - RNA, 21 nt, Artificial Sequence
  Description of Artificial Sequence: Target Sequence/siNA antisense region
ucuacgagaccucccggggca

SEQ ID NO: 1517 - RNA, 21 nt, Artificial Sequence
  Description of Artificial Sequence: Target Sequence/siNA sense region
ggccacaugaguggccaaggc

SEQ ID NO: 1518 - RNA, 21 nt, Artificial Sequence
  Description of Artificial Sequence: Target Sequence/siNA sense region
aggccacaugaguggccaagg

SEQ ID NO: 1519 - RNA, 21 nt, Artificial Sequence
  Description of Artificial Sequence: Target Sequence/siNA sense region
gggauaguccgucaugguguu

SEQ ID NO: 1520 - RNA, 21 nt, Artificial Sequence
  Description of Artificial Sequence: Target Sequence/siNA sense region
ugggauaguccgucauggugu

SEQ ID NO: 1521 - RNA, 21 nt, Artificial Sequence
  Description of Artificial Sequence: Target Sequence/siNA sense region
gugggauaguccgucauggug

SEQ ID NO: 1522 - RNA, 21 nt, Artificial Sequence
  Description of Artificial Sequence: Target Sequence/siNA sense region
cagaugcucuggagggccccg

SEQ ID NO: 1523 - RNA, 21 nt, Artificial Sequence
  Description of Artificial Sequence: Target Sequence/siNA sense region
ccagaugcucuggagggcccc

SEQ ID NO: 1524 - RNA, 21 nt, Artificial Sequence
  Description of Artificial Sequence: Target Sequence/siNA antisense region
acgccuuggccacucaugugg

SEQ ID NO: 1525 - RNA, 21 nt, Artificial Sequence
  Description of Artificial Sequence: Target Sequence/siNA antisense region
cgccuuggccacucauguggc

SEQ ID NO: 1526 - RNA, 21 nt, Artificial Sequence
  Description of Artificial Sequence: Target Sequence/siNA antisense region
ggaacaccaugacggacuauc

SEQ ID NO: 1527 - RNA, 21 nt, Artificial Sequence
  Description of Artificial Sequence: Target Sequence/siNA antisense region
gaacaccaugacggacuaucc

SEQ ID NO: 1528 - RNA, 21 nt, Artificial Sequence
  Description of Artificial Sequence: Target Sequence/siNA antisense region
aacaccaugacggacuauccc

SEQ ID NO: 1529 - RNA, 21 nt, Artificial Sequence
  Description of Artificial Sequence: Target Sequence/siNA antisense region
cacggggcccuccagagcauc

SEQ ID NO: 1530 - RNA, 21 nt, Artificial Sequence
  Description of Artificial Sequence: Target Sequence/siNA antisense region
acggggcccuccagagcaucu

SEQ ID NO: 1531 - RNA, 21 nt, Artificial Sequence
  Description of Artificial Sequence: Target Sequence/siNA sense region
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(1): Phosphorodithioate 3'-Internucleotide Linkage (optionally present)
  misc_feature (2)..(2): Phosphorodithioate 3'-Internucleotide Linkage (optionally present)
  misc_feature (3)..(3): Phosphorodithioate 3'-Internucleotide Linkage (optionally present)
  misc_feature (4)..(4): Phosphorodithioate 3'-Internucleotide Linkage (optionally present)
  misc_feature (5)..(5): Phosphorodithioate 3'-Internucleotide Linkage (optionally present)
  misc_feature (20)..(21): n stands for 5'-nitroindole
ccccgggaggucucguagann

SEQ ID NO: 1532 - RNA, 21 nt, Artificial Sequence
  Description of Artificial Sequence: Target Sequence/siNA sense region
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(1): Phosphorodithioate 3'-Internucleotide Linkage (optionally present)
  misc_feature (2)..(2): Phosphorodithioate 3'-Internucleotide Linkage (optionally present)
  misc_feature (3)..(3): Phosphorodithioate 3'-Internucleotide Linkage (optionally present)
  misc_feature (4)..(4): Phosphorodithioate 3'-Internucleotide Linkage (optionally present)
  misc_feature (5)..(5): Phosphorodithioate 3'-Internucleotide Linkage (optionally present)
  misc_feature (20)..(21): n stands for 5'-nitroindole
agaugcucuggagggccccnn

SEQ ID NO: 1533 - RNA, 21 nt, Artificial Sequence
  Description of Artificial Sequence: Target Sequence/siNA antisense region
  misc_feature (21)..(21): 3'-3 attached terminal deoxyabasic moiety, inverted abasic, inverted nucleotide or other terminal cap that is optionally present
  misc_feature (1)..(1): Phosphorodithioate 3'-Internucleotide Linkage (optionally present)
  misc_feature (2)..(2): Phosphorodithioate 3'-Internucleotide Linkage (optionally present)
  misc_feature (3)..(3)<<223>  Phosphorodithioate 3'-InternucleotideLinkage (optionally present)
  misc_feature (4)..(4): Phosphorodithioate 3'-Internucleotide Linkage (optionally present)
  misc_feature (5)..(5): Phosphorodithioate 3'-Internucleotide Linkage (optionally present)
  misc_feature (20)..(21): n stands for 5'-nitroindole
ucuacgagaccucccggggnn

SEQ ID NO: 1534 - RNA, 21 nt, Artificial Sequence
  Description of Artificial Sequence: Target Sequence/siNA antisense region
  misc_feature (21)..(21): 3'-3 attached terminal deoxyabasic moiety, inverted abasic, inverted nucleotide or other terminal cap that is optionally present
  misc_feature (1)..(1): Phosphorodithioate 3'-Internucleotide Linkage (optionally present)
  misc_feature (2)..(2): Phosphorodithioate 3'-Internucleotide Linkage (optionally present)
  misc_feature (3)..(3): Phosphorodithioate 3'-Internucleotide Linkage (optionally present)
  misc_feature (4)..(4): Phosphorodithioate 3'-Internucleotide Linkage (optionally present)
  misc_feature (5)..(5)<<223>  Phosphorodithioate 3'-InternucleotideLinkage (optionally present)
  misc_feature (20)..(21): n stands for 5'-nitroindole
ggggcccuccagagcaucunn

SEQ ID NO: 1535 - RNA, 21 nt, Artificial Sequence
  Description of Artificial Sequence: Target Sequence/siNA sense region
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(1): Phosphorodithioate 3'-Internucleotide Linkage (optionally present)
  misc_feature (2)..(2): Phosphorodithioate 3'-Internucleotide Linkage (optionally present)
  misc_feature (3)..(3): Phosphorodithioate 3'-Internucleotide Linkage (optionally present)
  misc_feature (4)..(4): Phosphorodithioate 3'-Internucleotide Linkage (optionally present)
  misc_feature (11)..(11): Phosphorodithioate 3'-Internucleotide Linkage (optionally present)
  misc_feature (12)..(12): Phosphorodithioate 3'-Internucleotide Linkage (optionally present)
  misc_feature (13)..(13): Phosphorodithioate 3'-Internucleotide Linkage (optionally present)
  misc_feature (14)..(14): Phosphorodithioate 3'-Internucleotide Linkage (optionally present)
  misc_feature (16)..(16): Phosphorodithioate 3'-Internucleotide Linkage (optionally present)
  misc_feature (20)..(21): n stands for 5'-nitroindole
ccccgggaggucucguagann

SEQ ID NO: 1536 - RNA, 21 nt, Artificial Sequence
  Description of Artificial Sequence: Target Sequence/siNA sense region
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (4)..(4): Phosphorodithioate 3'-Internucleotide Linkage (optionally present)
  misc_feature (6)..(6): Phosphorodithioate 3'-Internucleotide Linkage (optionally present)
  misc_feature (7)..(7): Phosphorodithioate 3'-Internucleotide Linkage (optionally present)
  misc_feature (8)..(8): Phosphorodithioate 3'-Internucleotide Linkage (optionally present)
  misc_feature (9)..(9): Phosphorodithioate 3'-Internucleotide Linkage (optionally present)
  misc_feature (16)..(16): Phosphorodithioate 3'-Internucleotide Linkage (optionally present)
  misc_feature (17)..(17): Phosphorodithioate 3'-Internucleotide Linkage (optionally present)
  misc_feature (18)..(18): Phosphorodithioate 3'-Internucleotide Linkage (optionally present)
  misc_feature (19)..(19): Phosphorodithioate 3'-Internucleotide Linkage (optionally present)
  misc_feature (20)..(21): n stands for 5'-nitroindole
agaugcucuggagggccccnn

SEQ ID NO: 1537 - RNA, 21 nt, Artificial Sequence
  Description of Artificial Sequence: Target Sequence/siNA antisense region
  misc_feature (21)..(21): 3'-3 attached terminal deoxyabasic moiety, inverted abasic, inverted nucleotide or other terminal cap that is optionally present
  misc_feature (1)..(1): Phosphorodithioate 3'-Internucleotide Linkage (optionally present)
  misc_feature (2)..(2): Phosphorodithioate 3'-Internucleotide Linkage (optionally present)
  misc_feature (3)..(3): Phosphorodithioate 3'-Internucleotide Linkage (optionally present)
  misc_feature (5)..(5): Phosphorodithioate 3'-Internucleotide Linkage (optionally present)
  misc_feature (10)..(10): Phosphorodithioate 3'-Internucleotide Linkage (optionally present)
  misc_feature (11)..(11): Phosphorodithioate 3'-Internucleotide Linkage (optionally present)
  misc_feature (12)..(12): Phosphorodithioate 3'-Internucleotide Linkage (optionally present)
  misc_feature (13)..(13): Phosphorodithioate 3'-Internucleotide Linkage (optionally present)
  misc_feature (14)..(14): Phosphorodithioate 3'-Internucleotide Linkage (optionally present)
  misc_feature (15)..(15): Phosphorodithioate 3'-Internucleotide Linkage (optionally present)
  misc_feature (20)..(21): n stands for 5'-nitroindole
ucuacgagaccucccggggnn

SEQ ID NO: 1538 - RNA, 21 nt, Artificial Sequence
  Description of Artificial Sequence: Target Sequence/siNA antisense region
  misc_feature (21)..(21): 3'-3 attached terminal deoxyabasic moiety, inverted abasic, inverted nucleotide or other terminal cap that is optionally present
  misc_feature (5)..(5): Phosphorodithioate 3'-Internucleotide Linkage (optionally present)
  misc_feature (6)..(6): Phosphorodithioate 3'-Internucleotide Linkage (optionally present)
  misc_feature (7)..(7): Phosphorodithioate 3'-Internucleotide Linkage (optionally present)
  misc_feature (8)..(8): Phosphorodithioate 3'-Internucleotide Linkage (optionally present)
  misc_feature (9)..(9): Phosphorodithioate 3'-Internucleotide Linkage (optionally present)
  misc_feature (10)..(10): Phosphorodithioate 3'-Internucleotide Linkage (optionally present)
  misc_feature (15)..(15): Phosphorodithioate 3'-Internucleotide Linkage (optionally present)
  misc_feature (17)..(17): Phosphorodithioate 3'-Internucleotide Linkage (optionally present)
  misc_feature (18)..(18): Phosphorodithioate 3'-Internucleotide Linkage (optionally present)
  misc_feature (19)..(19): Phosphorodithioate 3'-Internucleotide Linkage (optionally present)
  misc_feature (20)..(21): n stands for 5'-nitroindole
ggggcccuccagagcaucunn

SEQ ID NO: 1539 - RNA, 21 nt, Artificial Sequence
  Description of Artificial Sequence: Target Sequence/siNA sense region
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(1): 2'-deoxy-2'Fluoro
  misc_feature (1)..(1): Phosphorodithioate 3'-Internucleotide Linkage (optionally present)
  misc_feature (2)..(2): 2'-deoxy-2'Fluoro
  misc_feature (2)..(2): Phosphorodithioate 3'-Internucleotide Linkage (optionally present)
  misc_feature (3)..(3): 2'-deoxy-2'Fluoro
  misc_feature (3)..(3): Phosphorodithioate 3'-Internucleotide Linkage (optionally present)
  misc_feature (4)..(4): 2'-deoxy-2'Fluoro
  misc_feature (4)..(4): Phosphorodithioate 3'-Internucleotide Linkage (optionally present)
  misc_feature (11)..(14): 2'-deoxy-2'Fluoro
  misc_feature (16)..(16): 2'-deoxy-2'Fluoro
  misc_feature (17)..(17): Phosphorodithioate 3'-Internucleotide Linkage (optionally present)
  misc_feature (18)..(18): Phosphorodithioate 3'-Internucleotide Linkage (optionally present)
  misc_feature (19)..(19): Phosphorodithioate 3'-Internucleotide Linkage (optionally present)
  misc_feature (1)..(19): ribonucleotide unmodified or modified as described for this sequence
  misc_feature (20)..(21): n stands for 5'-nitroindole
ccccgggaggucucguagann

SEQ ID NO: 1540 - RNA, 21 nt, Artificial Sequence
  Description of Artificial Sequence: Target Sequence/siNA sense region
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(1): Phosphorodithioate 3'-Internucleotide Linkage (optionally present)
  misc_feature (2)..(2): Phosphorodithioate 3'-Internucleotide Linkage (optionally present)
  misc_feature (3)..(3): Phosphorodithioate 3'-Internucleotide Linkage (optionally present)
  misc_feature (4)..(4): 2'-deoxy-2'Fluoro
  misc_feature (4)..(4): Phosphorodithioate 3'-Internucleotide Linkage (optionally present)
  misc_feature (6)..(9): 2'-deoxy-2'Fluoro
  misc_feature (16)..(17): 2'-deoxy-2'Fluoro
  misc_feature (17)..(17): Phosphorodithioate 3'-Internucleotide Linkage (optionally present)
  misc_feature (18)..(18): 2'-deoxy-2'Fluoro
  misc_feature (18)..(18): Phosphorodithioate 3'-Internucleotide Linkage (optionally present)
  misc_feature (19)..(19): 2'-deoxy-2'Fluoro
  misc_feature (19)..(19): Phosphorodithioate 3'-Internucleotide Linkage (optionally present)
  misc_feature (1)..(19): ribonucleotide unmodified or modified as described for this sequence
  misc_feature (20)..(21): n stands for 5'-nitroindole
agaugcucuggagggccccnn

SEQ ID NO: 1541 - RNA, 21 nt, Artificial Sequence
  Description of Artificial Sequence: Target Sequence/siNA sense region
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(4): 2'-deoxy-2'Fluoro
  misc_feature (11)..(14): 2'-deoxy-2'Fluoro
  misc_feature (16)..(16): 2'-deoxy-2'Fluoro
  misc_feature (1)..(19): ribonucleotide unmodified or modified as described for this sequence
  misc_feature (20)..(21): n stands for 5'-nitroindole
ccccgggaggucucguagann

SEQ ID NO: 1542 - RNA, 21 nt, Artificial Sequence
  Description of Artificial Sequence: Target Sequence/siNA sense region
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (4)..(4): 2'-deoxy-2'Fluoro
  misc_feature (6)..(9): 2'-deoxy-2'Fluoro
  misc_feature (16)..(19): 2'-deoxy-2'Fluoro
  misc_feature (1)..(19): ribonucleotide unmodified or modified as described for this sequence
  misc_feature (20)..(21): n stands for 5'-nitroindole
agaugcucuggagggccccnn

SEQ ID NO: 1543 - RNA, 21 nt, Artificial Sequence
  Description of Artificial Sequence: Target Sequence/siNA antisense region
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(1): Phosphorodithioate 3'-Internucleotide Linkage (optionally present)
  misc_feature (2)..(2): Phosphorodithioate 3'-Internucleotide Linkage (optionally present)
  misc_feature (3)..(3): Phosphorodithioate 3'-Internucleotide Linkage (optionally present)
  misc_feature (5)..(5): Phosphorodithioate 3'-Internucleotide Linkage (optionally present)
  misc_feature (10)..(10): Phosphorodithioate 3'-Internucleotide Linkage (optionally present)
  misc_feature (11)..(11): Phosphorodithioate 3'-Internucleotide Linkage (optionally present)
  misc_feature (12)..(12): Phosphorodithioate 3'-Internucleotide Linkage (optionally present)
  misc_feature (13)..(13): Phosphorodithioate 3'-Internucleotide Linkage (optionally present)
  misc_feature (14)..(14): Phosphorodithioate 3'-Internucleotide Linkage (optionally present)
  misc_feature (15)..(15): Phosphorodithioate 3'-Internucleotide Linkage (optionally present)
  misc_feature (20)..(21): n stands for 5'-nitroindole
ucuacgagaccucccggggnn

SEQ ID NO: 1544 - RNA, 19 nt, Artificial Sequence
  Description of Artificial Sequence: Target Sequence/siNA antisense region
  misc_feature (1)..(3): 2'-deoxy-2'Fluoro
  misc_feature (5)..(5): 2'-deoxy-2'Fluoro
  misc_feature (10)..(15): 2'-deoxy-2'Fluoro
ucuacgagaccucccgggg

SEQ ID NO: 1545 - RNA, 21 nt, Artificial Sequence
  Description of Artificial Sequence: Target Sequence/siNA antisense region
  misc_feature (1)..(3): 2'-deoxy-2'Fluoro
  misc_feature (5)..(5): 2'-deoxy-2'Fluoro
  misc_feature (10)..(15): 2'-deoxy-2'Fluoro
  misc_feature (1)..(19): ribonucleotide unmodified or modified as described for this sequence
  misc_feature (20)..(21): n stands for 5'-nitroindole
ucuacgagaccucccggggnn

SEQ ID NO: 1546 - RNA, 21 nt, Artificial Sequence
  Description of Artificial Sequence: Target Sequence/siNA antisense region
  misc_feature (5)..(10): 2'-deoxy-2'Fluoro
  misc_feature (15)..(15): 2'-deoxy-2'Fluoro
  misc_feature (17)..(19): 2'-deoxy-2'Fluoro
  misc_feature (1)..(19): ribonucleotide unmodified or modified as described for this sequence
  misc_feature (20)..(21): n stands for 5'-nitroindole
ggggcccuccagagcaucunn

SEQ ID NO: 1547 - RNA, 21 nt, Artificial Sequence
  Description of Artificial Sequence: Target Sequence/siNA antisense region
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(3): 2'-deoxy-2'Fluoro
  misc_feature (5)..(5): 2'-deoxy-2'Fluoro
  misc_feature (10)..(15): 2'-deoxy-2'Fluoro
  misc_feature (1)..(19): ribonucleotide unmodified or modified as described for this sequence
  misc_feature (20)..(21): n stands for 5'-nitroindole
ucuacgagaccucccggggnn

SEQ ID NO: 1548 - RNA, 21 nt, Artificial Sequence
  Description of Artificial Sequence: Target Sequence/siNA sense region
  misc_feature (21)..(21): 3'-3 attached terminal deoxyabasic moiety, inverted abasic, inverted nucleotide or other terminal cap that is optionally present
  misc_feature (1)..(1): Phosphorothioate or Phosphorodithioate 3'-Internucleotide Linkage (optionally present)
  misc_feature (2)..(2): Phosphorothioate or Phosphorodithioate 3'-Internucleotide Linkage (optionally present)
  misc_feature (3)..(3): Phosphorothioate or Phosphorodithioate 3'-Internucleotide Linkage (optionally present)
  misc_feature (4)..(4): Phosphorothioate or Phosphorodithioate 3'-Internucleotide Linkage (optionally present)
  misc_feature (11)..(11): Phosphorothioate or Phosphorodithioate 3'-Internucleotide Linkage (optionally present)
  misc_feature (12)..(12): Phosphorothioate or Phosphorodithioate 3'-Internucleotide Linkage (optionally present)
  misc_feature (13)..(13): Phosphorothioate or Phosphorodithioate 3'-Internucleotide Linkage (optionally present)
  misc_feature (14)..(14): Phosphorothioate or Phosphorodithioate 3'-Internucleotide Linkage (optionally present)
  misc_feature (16)..(16): Phosphorothioate or Phosphorodithioate 3'-Internucleotide Linkage (optionally present)
  misc_feature (20)..(21): n stands for 5'-nitroindole
ccccgggaggucucguagann

SEQ ID NO: 1549 - RNA, 21 nt, Artificial Sequence
  Description of Artificial Sequence: Target Sequence/siNA sense region
  misc_feature (21)..(21): 3'-3 attached terminal deoxyabasic moiety, inverted abasic, inverted nucleotide or other terminal cap that is optionally present
ccccgggaggucucguagacc

SEQ ID NO: 1550 - RNA, 21 nt, Artificial Sequence
  Description of Artificial Sequence: Target Sequence/siNA sense region
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
ccccgggaggucucguagacc

SEQ ID NO: 1551 - RNA, 21 nt, Artificial Sequence
  Description of Artificial Sequence: Target Sequence/siNA antisense region
  misc_feature (21)..(21): 3'-3 attached terminal deoxyabasic moiety, inverted abasic, inverted nucleotide or other terminal cap that is optionally present
ucuacgagaccucccggggca

SEQ ID NO: 1552 - RNA, 21 nt, Artificial Sequence
  Description of Artificial Sequence: Target Sequence/siNA antisense region
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
ucuacgagaccucccggggca

SEQ ID NO: 1553 - DNA, 21 bp, Artificial Sequence
  Description of Artificial Sequence: Target Sequence/siNA sense region (stab06)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(4): 2'-deoxy-2'Fluoro
  misc_feature (11)..(14): 2'-deoxy-2'Fluoro
  misc_feature (16)..(16): 2'-deoxy-2'Fluoro
  misc_feature (1)..(19): ribonucleotide unmodified or modified as described for this sequence
ccccgggaggucucguagatt

SEQ ID NO: 1554 - DNA, 21 bp, Artificial Sequence
  Description of Artificial Sequence: Target Sequence/siNA antisense region
  misc_feature (20)..(20): Phosphorothioate or Phosphorodithioate 3'-Internucleotide Linkage (optionally present)
  misc_feature (1)..(3): 2'-deoxy-2'Fluoro
  misc_feature (5)..(5): 2'-deoxy-2'Fluoro
  misc_feature (10)..(15): 2'-deoxy-2'Fluoro
  misc_feature (1)..(19): ribonucleotide unmodified or modified as described for this sequence
ucuacgagaccucccggggtt

SEQ ID NO: 1555 - DNA, 21 bp, Artificial Sequence
  Description of Artificial Sequence: Target Sequence/siNA sense region (stab07)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(2): 2'-deoxy
  misc_feature (3)..(3): 2'-deoxy-2'Fluoro
  misc_feature (4)..(5): 2'-deoxy
  misc_feature (6)..(8): 2'-deoxy-2'Fluoro
  misc_feature (9)..(9): 2'-deoxy
  misc_feature (10)..(10): 2'-deoxy-2'Fluoro
  misc_feature (11)..(14): 2'-deoxy
  misc_feature (15)..(16): 2'-deoxy-2'Fluoro
  misc_feature (17)..(18): 2'-deoxy
  misc_feature (19)..(19): 2'-deoxy-2'Fluoro
  misc_feature (1)..(19): ribonucleotide unmodified or modified as described for this sequence
aguggucugcggaaccggutt

SEQ ID NO: 1556 - DNA, 21 bp, Artificial Sequence
  Description of Artificial Sequence: Target Sequence/siNA sense region (stab07)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(2): 2'-deoxy-2'Fluoro
  misc_feature (3)..(3): 2'-deoxy
  misc_feature (4)..(4): 2'-deoxy-2'Fluoro
  misc_feature (5)..(8): 2'-deoxy
  misc_feature (9)..(10): 2'-deoxy-2'Fluoro
  misc_feature (11)..(12): 2'-deoxy
  misc_feature (13)..(13): 2'-deoxy-2'Fluoro
  misc_feature (14)..(16): 2'-deoxy
  misc_feature (17)..(17): 2'-deoxy-2'Fluoro
  misc_feature (18)..(18): 2'-deoxy
  misc_feature (19)..(19): 2'-deoxy-2'Fluoro
  misc_feature (1)..(19): ribonucleotide unmodified or modified as described for this sequence
cugcggaaccggugaguactt

SEQ ID NO: 1557 - DNA, 21 bp, Artificial Sequence
  Description of Artificial Sequence: Target Sequence/siNA sense region (stab07)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(3): 2'-deoxy-2'Fluoro
  misc_feature (4)..(4): 2'-deoxy
  misc_feature (5)..(5): 2'-deoxy-2'Fluoro
  misc_feature (6)..(7): 2'-deoxy
  misc_feature (8)..(8): 2'-deoxy-2'Fluoro
  misc_feature (9)..(9): 2'-deoxy
  misc_feature (10)..(11): 2'-deoxy-2'Fluoro
  misc_feature (12)..(12): 2'-deoxy
  misc_feature (13)..(15): 2'-deoxy-2'Fluoro
  misc_feature (16)..(17): 2'-deoxy
  misc_feature (18)..(18): 2'-deoxy-2'Fluoro
  misc_feature (19)..(19): 2'-deoxy
  misc_feature (1)..(19): ribonucleotide unmodified or modified as described for this sequence
cuugugguacugccugauatt

SEQ ID NO: 1558 - DNA, 21 bp, Artificial Sequence
  Description of Artificial Sequence: Target Sequence/siNA sense region (stab07)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(1): 2'-deoxy-2'Fluoro
  misc_feature (2)..(3): 2'-deoxy
  misc_feature (4)..(4): 2'-deoxy-2'Fluoro
  misc_feature (5)..(5): 2'-deoxy
  misc_feature (6)..(7): 2'-deoxy-2'Fluoro
  misc_feature (8)..(8): 2'-deoxy
  misc_feature (9)..(11): 2'-deoxy-2'Fluoro
  misc_feature (12)..(13): 2'-deoxy
  misc_feature (14)..(14): 2'-deoxy-2'Fluoro
  misc_feature (15)..(18): 2'-deoxy
  misc_feature (19)..(19): 2'-deoxy-2'Fluoro
  misc_feature (1)..(19): ribonucleotide unmodified or modified as described for this sequence
ugguacugccugauagggutt

SEQ ID NO: 1559 - DNA, 21 bp, Artificial Sequence
  Description of Artificial Sequence: Target Sequence/siNA sense region (stab07)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(2): 2'-deoxy
  misc_feature (3)..(3): 2'-deoxy-2'Fluoro
  misc_feature (4)..(4): 2'-deoxy
  misc_feature (5)..(6): 2'-deoxy-2'Fluoro
  misc_feature (7)..(7): 2'-deoxy
  misc_feature (8)..(10): 2'-deoxy-2'Fluoro
  misc_feature (11)..(12): 2'-deoxy
  misc_feature (13)..(13): 2'-deoxy-2'Fluoro
  misc_feature (14)..(17): 2'-deoxy
  misc_feature (18)..(18): 2'-deoxy-2'Fluoro
  misc_feature (19)..(19): 2'-deoxy
  misc_feature (1)..(19): ribonucleotide unmodified or modified as described for this sequence
gguacugccugauagggugtt

SEQ ID NO: 1560 - DNA, 21 bp, Artificial Sequence
  Description of Artificial Sequence: Target Sequence/siNA sense region (stab07)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(1): 2'-deoxy
  misc_feature (2)..(2): 2'-deoxy-2'Fluoro
  misc_feature (3)..(3): 2'-deoxy
  misc_feature (4)..(5): 2'-deoxy-2'Fluoro
  misc_feature (6)..(6): 2'-deoxy
  misc_feature (7)..(9): 2'-deoxy-2'Fluoro
  misc_feature (10)..(11): 2'-deoxy
  misc_feature (12)..(12): 2'-deoxy-2'Fluoro
  misc_feature (13)..(16): 2'-deoxy
  misc_feature (17)..(17): 2'-deoxy-2'Fluoro
  misc_feature (18)..(18): 2'-deoxy
  misc_feature (19)..(19): 2'-deoxy-2'Fluoro
  misc_feature (1)..(19): ribonucleotide unmodified or modified as described for this sequence
guacugccugauagggugctt

SEQ ID NO: 1561 - DNA, 21 bp, Artificial Sequence
  Description of Artificial Sequence: Target Sequence/siNA sense region (stab07)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(1): 2'-deoxy-2'Fluoro
  misc_feature (2)..(2): 2'-deoxy
  misc_feature (3)..(4): 2'-deoxy-2'Fluoro
  misc_feature (5)..(5): 2'-deoxy
  misc_feature (6)..(8): 2'-deoxy-2'Fluoro
  misc_feature (9)..(10): 2'-deoxy
  misc_feature (11)..(11): 2'-deoxy-2'Fluoro
  misc_feature (12)..(15): 2'-deoxy
  misc_feature (16)..(16): 2'-deoxy-2'Fluoro
  misc_feature (17)..(17): 2'-deoxy
  misc_feature (18)..(19): 2'-deoxy-2'Fluoro
  misc_feature (1)..(19): ribonucleotide unmodified or modified as described for this sequence
uacugccugauagggugcutt

SEQ ID NO: 1562 - DNA, 21 bp, Artificial Sequence
  Description of Artificial Sequence: Target Sequence/siNA sense region (stab07)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(2): 2'-deoxy-2'Fluoro
  misc_feature (3)..(3): 2'-deoxy
  misc_feature (4)..(6): 2'-deoxy-2'Fluoro
  misc_feature (7)..(8): 2'-deoxy
  misc_feature (9)..(9): 2'-deoxy-2'Fluoro
  misc_feature (10)..(13): 2'-deoxy
  misc_feature (14)..(14): 2'-deoxy-2'Fluoro
  misc_feature (15)..(15): 2'-deoxy
  misc_feature (16)..(18): 2'-deoxy-2'Fluoro
  misc_feature (19)..(19): 2'-deoxy
  misc_feature (1)..(19): ribonucleotide unmodified or modified as described for this sequence
cugccugauagggugcuugtt

SEQ ID NO: 1563 - DNA, 21 bp, Artificial Sequence
  Description of Artificial Sequence: Target Sequence/siNA sense region (stab07)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(1): 2'-deoxy-2'Fluoro
  misc_feature (2)..(2): 2'-deoxy
  misc_feature (3)..(5): 2'-deoxy-2'Fluoro
  misc_feature (6)..(7): 2'-deoxy
  misc_feature (8)..(8): 2'-deoxy-2'Fluoro
  misc_feature (9)..(12): 2'-deoxy
  misc_feature (13)..(13): 2'-deoxy-2'Fluoro
  misc_feature (14)..(14): 2'-deoxy
  misc_feature (15)..(17): 2'-deoxy-2'Fluoro
  misc_feature (18)..(18): 2'-deoxy
  misc_feature (19)..(19): 2'-deoxy-2'Fluoro
  misc_feature (1)..(19): ribonucleotide unmodified or modified as described for this sequence
ugccugauagggugcuugctt

SEQ ID NO: 1564 - DNA, 21 bp, Artificial Sequence
  Description of Artificial Sequence: Target Sequence/siNA sense region (stab07)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(3): 2'-deoxy-2'Fluoro
  misc_feature (4)..(5): 2'-deoxy
  misc_feature (6)..(6): 2'-deoxy-2'Fluoro
  misc_feature (7)..(10): 2'-deoxy
  misc_feature (11)..(11): 2'-deoxy-2'Fluoro
  misc_feature (12)..(12): 2'-deoxy
  misc_feature (13)..(15): 2'-deoxy-2'Fluoro
  misc_feature (16)..(16): 2'-deoxy
  misc_feature (17)..(17): 2'-deoxy-2'Fluoro
  misc_feature (18)..(19): 2'-deoxy
  misc_feature (1)..(19): ribonucleotide unmodified or modified as described for this sequence
ccugauagggugcuugcgatt

SEQ ID NO: 1565 - DNA, 21 bp, Artificial Sequence
  Description of Artificial Sequence: Target Sequence/siNA sense region (stab07)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(2): 2'-deoxy
  misc_feature (3)..(3): 2'-deoxy-2'Fluoro
  misc_feature (4)..(7): 2'-deoxy
  misc_feature (8)..(8): 2'-deoxy-2'Fluoro
  misc_feature (9)..(9): 2'-deoxy
  misc_feature (10)..(12): 2'-deoxy-2'Fluoro
  misc_feature (13)..(13): 2'-deoxy
  misc_feature (14)..(14): 2'-deoxy-2'Fluoro
  misc_feature (15)..(17): 2'-deoxy
  misc_feature (18)..(18): 2'-deoxy-2'Fluoro
  misc_feature (19)..(19): 2'-deoxy
  misc_feature (1)..(19): ribonucleotide unmodified or modified as described for this sequence
gauagggugcuugcgagugtt

SEQ ID NO: 1566 - DNA, 21 bp, Artificial Sequence
  Description of Artificial Sequence: Target Sequence/siNA sense region (stab07)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(1): 2'-deoxy
  misc_feature (2)..(5): 2'-deoxy-2'Fluoro
  misc_feature (6)..(11): 2'-deoxy
  misc_feature (12)..(15): 2'-deoxy-2'Fluoro
  misc_feature (16)..(16): 2'-deoxy
  misc_feature (17)..(17): 2'-deoxy-2'Fluoro
  misc_feature (18)..(19): 2'-deoxy
  misc_feature (1)..(19): ribonucleotide unmodified or modified as described for this sequence
gccccgggaggucucguagtt

SEQ ID NO: 1567 - DNA, 21 bp, Artificial Sequence
  Description of Artificial Sequence: Target Sequence/siNA antisense region (stab08)
  misc_feature (20)..(20): Phosphorothioate or Phosphorodithioate 3'-Internucleotide Linkage (optionally present)
  misc_feature (2)..(3): 2'-deoxy-2'Fluoro
  misc_feature (4)..(5): 2'-O-methyl
  misc_feature (6)..(9): 2'-deoxy-2'Fluoro
  misc_feature (10)..(10): 2'-O-methyl
  misc_feature (11)..(11): 2'-deoxy-2'Fluoro
  misc_feature (12)..(14): 2'-O-methyl
  misc_feature (15)..(16): 2'-deoxy-2'Fluoro
  misc_feature (17)..(17): 2'-O-methyl
  misc_feature (18)..(19): 2'-deoxy-2'Fluoro
  misc_feature (1)..(19): ribonucleotide unmodified or modified as described for this sequence
accgguuccgcagaccacutt

SEQ ID NO: 1568 - DNA, 21 bp, Artificial Sequence
  Description of Artificial Sequence: Target Sequence/siNA antisense region (stab08)
  misc_feature (20)..(20): Phosphorothioate or Phosphorodithioate 3'-Internucleotide Linkage (optionally present)
  misc_feature (2)..(2): 2'-deoxy-2'Fluoro
  misc_feature (3)..(3): 2'-O-methyl
  misc_feature (4)..(6): 2'-deoxy-2'Fluoro
  misc_feature (7)..(7): 2'-O-methyl
  misc_feature (8)..(9): 2'-deoxy-2'Fluoro
  misc_feature (10)..(11): 2'-O-methyl
  misc_feature (12)..(15): 2'-deoxy-2'Fluoro
  misc_feature (16)..(16): 2'-O-methyl
  misc_feature (17)..(17): 2'-deoxy-2'Fluoro
  misc_feature (18)..(19): 2'-O-methyl
  misc_feature (1)..(19): ribonucleotide unmodified or modified as described for this sequence
guacucaccgguuccgcagtt

SEQ ID NO: 1569 - DNA, 21 bp, Artificial Sequence
  Description of Artificial Sequence: Target Sequence/siNA antisense region (stab08)
  misc_feature (20)..(20): Phosphorothioate or Phosphorodithioate 3'-Internucleotide Linkage (optionally present)
  misc_feature (1)..(1): 2'-deoxy-2'Fluoro
  misc_feature (2)..(2): 2'-O-methyl
  misc_feature (3)..(4): 2'-deoxy-2'Fluoro
  misc_feature (5)..(7): 2'-O-methyl
  misc_feature (8)..(8): 2'-deoxy-2'Fluoro
  misc_feature (9)..(10): 2'-O-methyl
  misc_feature (11)..(11): 2'-deoxy-2'Fluoro
  misc_feature (12)..(12): 2'-O-methyl
  misc_feature (13)..(14): 2'-deoxy-2'Fluoro
  misc_feature (15)..(15): 2'-O-methyl
  misc_feature (16)..(16): 2'-deoxy-2'Fluoro
  misc_feature (17)..(19): 2'-O-methyl
  misc_feature (1)..(19): ribonucleotide unmodified or modified as described for this sequence
uaucaggcaguaccacaagtt

SEQ ID NO: 1570 - DNA, 21 bp, Artificial Sequence
  Description of Artificial Sequence: Target Sequence/siNA antisense region (stab08)
  misc_feature (20)..(20): Phosphorothioate or Phosphorodithioate 3'-Internucleotide Linkage (optionally present)
  misc_feature (2)..(5): 2'-deoxy-2'Fluoro
  misc_feature (6)..(6): 2'-O-methyl
  misc_feature (7)..(8): 2'-deoxy-2'Fluoro
  misc_feature (9)..(11): 2'-O-methyl
  misc_feature (12)..(12): 2'-deoxy-2'Fluoro
  misc_feature (13)..(14): 2'-O-methyl
  misc_feature (15)..(15): 2'-deoxy-2'Fluoro
  misc_feature (16)..(16): 2'-O-methyl
  misc_feature (17)..(18): 2'-deoxy-2'Fluoro
  misc_feature (19)..(19): 2'-O-methyl
  misc_feature (1)..(19): ribonucleotide unmodified or modified as described for this sequence
acccuaucaggcaguaccatt

SEQ ID NO: 1571 - DNA, 21 bp, Artificial Sequence
  Description of Artificial Sequence: Target Sequence/siNA antisense region (stab08)
  misc_feature (20)..(20): Phosphorothioate or Phosphorodithioate 3'-Internucleotide Linkage (optionally present)
  misc_feature (1)..(1): 2'-deoxy-2'Fluoro
  misc_feature (2)..(2): 2'-O-methyl
  misc_feature (3)..(6): 2'-deoxy-2'Fluoro
  misc_feature (7)..(7): 2'-O-methyl
  misc_feature (8)..(9): 2'-deoxy-2'Fluoro
  misc_feature (10)..(12): 2'-O-methyl
  misc_feature (13)..(13): 2'-deoxy-2'Fluoro
  misc_feature (14)..(15): 2'-O-methyl
  misc_feature (16)..(16): 2'-deoxy-2'Fluoro
  misc_feature (17)..(17): 2'-O-methyl
  misc_feature (18)..(19): 2'-deoxy-2'Fluoro
  misc_feature (1)..(19): ribonucleotide unmodified or modified as described for this sequence
cacccuaucaggcaguacctt

SEQ ID NO: 1572 - DNA, 21 bp, Artificial Sequence
  Description of Artificial Sequence: Target Sequence/siNA antisense region (stab08)
  misc_feature (20)..(20): Phosphorothioate or Phosphorodithioate 3'-Internucleotide Linkage (optionally present)
  misc_feature (2)..(2): 2'-deoxy-2'Fluoro
  misc_feature (3)..(3): 2'-O-methyl
  misc_feature (4)..(7): 2'-deoxy-2'Fluoro
  misc_feature (8)..(8): 2'-O-methyl
  misc_feature (9)..(10): 2'-deoxy-2'Fluoro
  misc_feature (11)..(13): 2'-O-methyl
  misc_feature (14)..(14): 2'-deoxy-2'Fluoro
  misc_feature (15)..(16): 2'-O-methyl
  misc_feature (17)..(17): 2'-deoxy-2'Fluoro
  misc_feature (18)..(18): 2'-O-methyl
  misc_feature (19)..(19): 2'-deoxy-2'Fluoro
  misc_feature (1)..(19): ribonucleotide unmodified or modified as described for this sequence
gcacccuaucaggcaguactt

SEQ ID NO: 1573 - DNA, 21 bp, Artificial Sequence
  Description of Artificial Sequence: Target Sequence/siNA antisense region (stab08)
  misc_feature (20)..(20): Phosphorothioate or Phosphorodithioate 3'-Internucleotide Linkage (optionally present)
  misc_feature (3)..(3): 2'-deoxy-2'Fluoro
  misc_feature (4)..(4): 2'-O-methyl
  misc_feature (5)..(8): 2'-deoxy-2'Fluoro
  misc_feature (9)..(9): 2'-O-methyl
  misc_feature (10)..(11): 2'-deoxy-2'Fluoro
  misc_feature (12)..(14): 2'-O-methyl
  misc_feature (15)..(15): 2'-deoxy-2'Fluoro
  misc_feature (16)..(17): 2'-O-methyl
  misc_feature (18)..(18): 2'-deoxy-2'Fluoro
  misc_feature (19)..(19): 2'-O-methyl
  misc_feature (1)..(19): ribonucleotide unmodified or modified as described for this sequence
agcacccuaucaggcaguatt

SEQ ID NO: 1574 - DNA, 21 bp, Artificial Sequence
  Description of Artificial Sequence: Target Sequence/siNA antisense region (stab08)
  misc_feature (20)..(20): Phosphorothioate or Phosphorodithioate 3'-Internucleotide Linkage (optionally present)
  misc_feature (1)..(1): 2'-deoxy-2'Fluoro
  misc_feature (2)..(4): 2'-O-methyl
  misc_feature (5)..(5): 2'-deoxy-2'Fluoro
  misc_feature (6)..(6): 2'-O-methyl
  misc_feature (7)..(10): 2'-deoxy-2'Fluoro
  misc_feature (11)..(11): 2'-O-methyl
  misc_feature (12)..(13): 2'-deoxy-2'Fluoro
  misc_feature (14)..(16): 2'-O-methyl
  misc_feature (17)..(17): 2'-deoxy-2'Fluoro
  misc_feature (18)..(19): 2'-O-methyl
  misc_feature (1)..(19): ribonucleotide unmodified or modified as described for this sequence
caagcacccuaucaggcagtt

SEQ ID NO: 1575 - DNA, 21 bp, Artificial Sequence
  Description of Artificial Sequence: Target Sequence/siNA antisense region (stab08)
  misc_feature (20)..(20): Phosphorothioate or Phosphorodithioate 3'-Internucleotide Linkage (optionally present)
  misc_feature (2)..(2): 2'-deoxy-2'Fluoro
  misc_feature (3)..(5): 2'-O-methyl
  misc_feature (6)..(6): 2'-deoxy-2'Fluoro
  misc_feature (7)..(7): 2'-O-methyl
  misc_feature (8)..(11): 2'-deoxy-2'Fluoro
  misc_feature (12)..(12): 2'-O-methyl
  misc_feature (13)..(14): 2'-deoxy-2'Fluoro
  misc_feature (15)..(17): 2'-O-methyl
  misc_feature (18)..(18): 2'-deoxy-2'Fluoro
  misc_feature (19)..(19): 2'-O-methyl
  misc_feature (1)..(19): ribonucleotide unmodified or modified as described for this sequence
gcaagcacccuaucaggcatt

SEQ ID NO: 1576 - DNA, 21 bp, Artificial Sequence
  Description of Artificial Sequence: Target Sequence/siNA antisense region (stab08)
  misc_feature (20)..(20): Phosphorothioate or Phosphorodithioate 3'-Internucleotide Linkage (optionally present)
  misc_feature (1)..(2): 2'-deoxy-2'Fluoro
  misc_feature (3)..(3): 2'-O-methyl
  misc_feature (4)..(4): 2'-deoxy-2'Fluoro
  misc_feature (5)..(7): 2'-O-methyl
  misc_feature (8)..(8): 2'-deoxy-2'Fluoro
  misc_feature (9)..(9): 2'-O-methyl
  misc_feature (10)..(13): 2'-deoxy-2'Fluoro
  misc_feature (14)..(14): 2'-O-methyl
  misc_feature (15)..(16): 2'-deoxy-2'Fluoro
  misc_feature (17)..(19): 2'-O-methyl
  misc_feature (1)..(19): ribonucleotide unmodified or modified as described for this sequence
ucgcaagcacccuaucaggtt

SEQ ID NO: 1577 - DNA, 21 bp, Artificial Sequence
  Description of Artificial Sequence: Target Sequence/siNA antisense region (stab08)
  misc_feature (20)..(20): Phosphorothioate or Phosphorodithioate 3'-Internucleotide Linkage (optionally present)
  misc_feature (1)..(1): 2'-deoxy-2'Fluoro
  misc_feature (2)..(2): 2'-O-methyl
  misc_feature (3)..(5): 2'-deoxy-2'Fluoro
  misc_feature (6)..(6): 2'-O-methyl
  misc_feature (7)..(7): 2'-deoxy-2'Fluoro
  misc_feature (8)..(10): 2'-O-methyl
  misc_feature (11)..(11): 2'-deoxy-2'Fluoro
  misc_feature (12)..(12): 2'-O-methyl
  misc_feature (13)..(16): 2'-deoxy-2'Fluoro
  misc_feature (17)..(17): 2'-O-methyl
  misc_feature (18)..(19): 2'-deoxy-2'Fluoro
  misc_feature (1)..(19): ribonucleotide unmodified or modified as described for this sequence
cacucgcaagcacccuauctt

SEQ ID NO: 1578 - DNA, 21 bp, Artificial Sequence
  Description of Artificial Sequence: Target Sequence/siNA antisense region (stab08)
  misc_feature (20)..(20): Phosphorothioate or Phosphorodithioate 3'-Internucleotide Linkage (optionally present)
  misc_feature (1)..(2): 2'-deoxy-2'Fluoro
  misc_feature (3)..(3): 2'-O-methyl
  misc_feature (4)..(4): 2'-deoxy-2'Fluoro
  misc_feature (5)..(8): 2'-O-methyl
  misc_feature (9)..(14): 2'-deoxy-2'Fluoro
  misc_feature (15)..(18): 2'-O-methyl
  misc_feature (19)..(19): 2'-deoxy-2'Fluoro
  misc_feature (1)..(19): ribonucleotide unmodified or modified as described for this sequence
cuacgagaccucccggggctt

SEQ ID NO: 1579 - DNA, 21 bp, Artificial Sequence
  Description of Artificial Sequence: Target Sequence/siNA sense region (stab07)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(1): 2'-deoxy-2'Fluoro
  misc_feature (2)..(3): 2'-deoxy
  misc_feature (4)..(5): 2'-deoxy-2'Fluoro
  misc_feature (6)..(9): 2'-deoxy
  misc_feature (10)..(10): 2'-deoxy-2'Fluoro
  misc_feature (11)..(11): 2'-deoxy
  misc_feature (12)..(14): 2'-deoxy-2'Fluoro
  misc_feature (15)..(16): 2'-deoxy
  misc_feature (17)..(17): 2'-deoxy-2'Fluoro
  misc_feature (18)..(19): 2'-deoxy
  misc_feature (1)..(19): ribonucleotide unmodified or modified as described for this sequence
uggccaaggcgucuggugatt

SEQ ID NO: 1580 - DNA, 21 bp, Artificial Sequence
  Description of Artificial Sequence: Target Sequence/siNA sense region (stab07)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(1): 2'-deoxy-2'Fluoro
  misc_feature (2)..(2): 2'-deoxy
  misc_feature (3)..(3): 2'-deoxy-2'Fluoro
  misc_feature (4)..(6): 2'-deoxy
  misc_feature (7)..(7): 2'-deoxy-2'Fluoro
  misc_feature (8)..(9): 2'-deoxy
  misc_feature (10)..(11): 2'-deoxy-2'Fluoro
  misc_feature (12)..(15): 2'-deoxy
  misc_feature (16)..(16): 2'-deoxy-2'Fluoro
  misc_feature (17)..(17): 2'-deoxy
  misc_feature (18)..(19): 2'-deoxy-2'Fluoro
  misc_feature (1)..(19): ribonucleotide unmodified or modified as described for this sequence
caugaguggccaaggcguctt

SEQ ID NO: 1581 - DNA, 21 bp, Artificial Sequence
  Description of Artificial Sequence: Target Sequence/siNA sense region (stab07)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(1): 2'-deoxy
  misc_feature (2)..(2): 2'-deoxy-2'Fluoro
  misc_feature (3)..(4): 2'-deoxy
  misc_feature (5)..(7): 2'-deoxy-2'Fluoro
  misc_feature (8)..(8): 2'-deoxy
  misc_feature (9)..(10): 2'-deoxy-2'Fluoro
  misc_feature (11)..(11): 2'-deoxy
  misc_feature (12)..(12): 2'-deoxy-2'Fluoro
  misc_feature (13)..(14): 2'-deoxy
  misc_feature (15)..(15): 2'-deoxy-2'Fluoro
  misc_feature (16)..(16): 2'-deoxy
  misc_feature (17)..(19): 2'-deoxy-2'Fluoro
  misc_feature (1)..(19): ribonucleotide unmodified or modified as described for this sequence
auaguccgucaugguguuctt

SEQ ID NO: 1582 - DNA, 21 bp, Artificial Sequence
  Description of Artificial Sequence: Target Sequence/siNA sense region (stab07)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(1): 2'-deoxy-2'Fluoro
  misc_feature (2)..(5): 2'-deoxy
  misc_feature (6)..(6): 2'-deoxy-2'Fluoro
  misc_feature (7)..(8): 2'-deoxy
  misc_feature (9)..(11): 2'-deoxy-2'Fluoro
  misc_feature (12)..(12): 2'-deoxy
  misc_feature (13)..(14): 2'-deoxy-2'Fluoro
  misc_feature (15)..(15): 2'-deoxy
  misc_feature (16)..(16): 2'-deoxy-2'Fluoro
  misc_feature (17)..(18): 2'-deoxy
  misc_feature (19)..(19): 2'-deoxy-2'Fluoro
  misc_feature (1)..(19): ribonucleotide unmodified or modified as described for this sequence
ugggauaguccgucauggutt

SEQ ID NO: 1583 - DNA, 21 bp, Artificial Sequence
  Description of Artificial Sequence: Target Sequence/siNA sense region (stab07)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(1): 2'-deoxy
  misc_feature (2)..(2): 2'-deoxy-2'Fluoro
  misc_feature (3)..(6): 2'-deoxy
  misc_feature (7)..(7): 2'-deoxy-2'Fluoro
  misc_feature (8)..(9): 2'-deoxy
  misc_feature (10)..(12): 2'-deoxy-2'Fluoro
  misc_feature (13)..(13): 2'-deoxy
  misc_feature (14)..(15): 2'-deoxy-2'Fluoro
  misc_feature (16)..(16): 2'-deoxy
  misc_feature (17)..(17): 2'-deoxy-2'Fluoro
  misc_feature (18)..(19): 2'-deoxy
  misc_feature (1)..(19): ribonucleotide unmodified or modified as described for this sequence
gugggauaguccgucauggtt

SEQ ID NO: 1584 - DNA, 21 bp, Artificial Sequence
  Description of Artificial Sequence: Target Sequence/siNA sense region (stab07)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(1): 2'-deoxy-2'Fluoro
  misc_feature (2)..(2): 2'-deoxy
  misc_feature (3)..(3): 2'-deoxy-2'Fluoro
  misc_feature (4)..(7): 2'-deoxy
  misc_feature (8)..(8): 2'-deoxy-2'Fluoro
  misc_feature (9)..(10): 2'-deoxy
  misc_feature (11)..(13): 2'-deoxy-2'Fluoro
  misc_feature (14)..(14): 2'-deoxy
  misc_feature (15)..(16): 2'-deoxy-2'Fluoro
  misc_feature (17)..(17): 2'-deoxy
  misc_feature (18)..(18): 2'-deoxy-2'Fluoro
  misc_feature (19)..(19): 2'-deoxy
  misc_feature (1)..(19): ribonucleotide unmodified or modified as described for this sequence
cgugggauaguccgucaugtt

SEQ ID NO: 1585 - DNA, 21 bp, Artificial Sequence
  Description of Artificial Sequence: Target Sequence/siNA sense region (stab07)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(2): 2'-deoxy-2'Fluoro
  misc_feature (3)..(3): 2'-deoxy
  misc_feature (4)..(4): 2'-deoxy-2'Fluoro
  misc_feature (5)..(8): 2'-deoxy
  misc_feature (9)..(9): 2'-deoxy-2'Fluoro
  misc_feature (10)..(11): 2'-deoxy
  misc_feature (12)..(14): 2'-deoxy-2'Fluoro
  misc_feature (15)..(15): 2'-deoxy
  misc_feature (16)..(17): 2'-deoxy-2'Fluoro
  misc_feature (18)..(18): 2'-deoxy
  misc_feature (19)..(19): 2'-deoxy-2'Fluoro
  misc_feature (1)..(19): ribonucleotide unmodified or modified as described for this sequence
ucgugggauaguccgucautt

SEQ ID NO: 1586 - DNA, 21 bp, Artificial Sequence
  Description of Artificial Sequence: Target Sequence/siNA sense region (stab07)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(1): 2'-deoxy
  misc_feature (2)..(4): 2'-deoxy-2'Fluoro
  misc_feature (5)..(5): 2'-deoxy
  misc_feature (6)..(6): 2'-deoxy-2'Fluoro
  misc_feature (7)..(10): 2'-deoxy
  misc_feature (11)..(11): 2'-deoxy-2'Fluoro
  misc_feature (12)..(13): 2'-deoxy
  misc_feature (14)..(16): 2'-deoxy-2'Fluoro
  misc_feature (17)..(17): 2'-deoxy
  misc_feature (18)..(19): 2'-deoxy-2'Fluoro
  misc_feature (1)..(19): ribonucleotide unmodified or modified as described for this sequence
guucgugggauaguccguctt

SEQ ID NO: 1587 - DNA, 21 bp, Artificial Sequence
  Description of Artificial Sequence: Target Sequence/siNA sense region (stab07)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(1): 2'-deoxy-2'Fluoro
  misc_feature (2)..(2): 2'-deoxy
  misc_feature (3)..(5): 2'-deoxy-2'Fluoro
  misc_feature (6)..(6): 2'-deoxy
  misc_feature (7)..(7): 2'-deoxy-2'Fluoro
  misc_feature (8)..(11): 2'-deoxy
  misc_feature (12)..(12): 2'-deoxy-2'Fluoro
  misc_feature (13)..(14): 2'-deoxy
  misc_feature (15)..(17): 2'-deoxy-2'Fluoro
  misc_feature (18)..(18): 2'-deoxy
  misc_feature (19)..(19): 2'-deoxy-2'Fluoro
  misc_feature (1)..(19): ribonucleotide unmodified or modified as described for this sequence
cguucgugggauaguccgutt

SEQ ID NO: 1588 - DNA, 21 bp, Artificial Sequence
  Description of Artificial Sequence: Target Sequence/siNA sense region (stab07)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(2): 2'-deoxy
  misc_feature (3)..(3): 2'-deoxy-2'Fluoro
  misc_feature (4)..(4): 2'-deoxy
  misc_feature (5)..(7): 2'-deoxy-2'Fluoro
  misc_feature (8)..(8): 2'-deoxy
  misc_feature (9)..(9): 2'-deoxy-2'Fluoro
  misc_feature (10)..(13): 2'-deoxy
  misc_feature (14)..(14): 2'-deoxy-2'Fluoro
  misc_feature (15)..(16): 2'-deoxy
  misc_feature (17)..(19): 2'-deoxy-2'Fluoro
  misc_feature (1)..(19): ribonucleotide unmodified or modified as described for this sequence
agcguucgugggauagucctt

SEQ ID NO: 1589 - DNA, 21 bp, Artificial Sequence
  Description of Artificial Sequence: Target Sequence/siNA sense region (stab07)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(1): 2'-deoxy
  misc_feature (2)..(2): 2'-deoxy-2'Fluoro
  misc_feature (3)..(5): 2'-deoxy
  misc_feature (6)..(6): 2'-deoxy-2'Fluoro
  misc_feature (7)..(7): 2'-deoxy
  misc_feature (8)..(10): 2'-deoxy-2'Fluoro
  misc_feature (11)..(11): 2'-deoxy
  misc_feature (12)..(12): 2'-deoxy-2'Fluoro
  misc_feature (13)..(16): 2'-deoxy
  misc_feature (17)..(17): 2'-deoxy-2'Fluoro
  misc_feature (18)..(19): 2'-deoxy
  misc_feature (1)..(19): ribonucleotide unmodified or modified as described for this sequence
gugagcguucgugggauagtt

SEQ ID NO: 1590 - DNA, 21 bp, Artificial Sequence
  Description of Artificial Sequence: Target Sequence/siNA sense region (stab07)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(2): 2'-deoxy
  misc_feature (3)..(3): 2'-deoxy-2'Fluoro
  misc_feature (4)..(4): 2'-deoxy
  misc_feature (5)..(8): 2'-deoxy-2'Fluoro
  misc_feature (9)..(14): 2'-deoxy
  misc_feature (15)..(18): 2'-deoxy-2'Fluoro
  misc_feature (19)..(19): 2'-deoxy
  misc_feature (1)..(19): ribonucleotide unmodified or modified as described for this sequence
gaugcucuggagggccccgtt

SEQ ID NO: 1591 - DNA, 21 bp, Artificial Sequence
  Description of Artificial Sequence: Target Sequence/siNA antisense region (stab08)
  misc_feature (20)..(20): Phosphorothioate or Phosphorodithioate 3'-Internucleotide Linkage (optionally present)
  misc_feature (1)..(2): 2'-deoxy-2'Fluoro
  misc_feature (3)..(3): 2'-O-methyl
  misc_feature (4)..(5): 2'-deoxy-2'Fluoro
  misc_feature (6)..(8): 2'-O-methyl
  misc_feature (9)..(9): 2'-deoxy-2'Fluoro
  misc_feature (10)..(10): 2'-O-methyl
  misc_feature (11)..(14): 2'-deoxy-2'Fluoro
  misc_feature (15)..(16): 2'-O-methyl
  misc_feature (17)..(18): 2'-deoxy-2'Fluoro
  misc_feature (19)..(19): 2'-O-methyl
  misc_feature (1)..(19): ribonucleotide unmodified or modified as described for this sequence
ucaccagacgccuuggccatt

SEQ ID NO: 1592 - DNA, 21 bp, Artificial Sequence
  Description of Artificial Sequence: Target Sequence/siNA antisense region (stab08)
  misc_feature (20)..(20): Phosphorothioate or Phosphorodithioate 3'-Internucleotide Linkage (optionally present)
  misc_feature (2)..(3): 2'-deoxy-2'Fluoro
  misc_feature (4)..(4): 2'-O-methyl
  misc_feature (5)..(8): 2'-deoxy-2'Fluoro
  misc_feature (9)..(10): 2'-O-methyl
  misc_feature (11)..(12): 2'-deoxy-2'Fluoro
  misc_feature (13)..(13): 2'-O-methyl
  misc_feature (14)..(16): 2'-deoxy-2'Fluoro
  misc_feature (17)..(17): 2'-O-methyl
  misc_feature (18)..(18): 2'-deoxy-2'Fluoro
  misc_feature (19)..(19): 2'-O-methyl
  misc_feature (1)..(19): ribonucleotide unmodified or modified as described for this sequence
gacgccuuggccacucaugtt

SEQ ID NO: 1593 - DNA, 21 bp, Artificial Sequence
  Description of Artificial Sequence: Target Sequence/siNA antisense region (stab08)
  misc_feature (20)..(20): Phosphorothioate or Phosphorodithioate 3'-Internucleotide Linkage (optionally present)
  misc_feature (4)..(4): 2'-deoxy-2'Fluoro
  misc_feature (5)..(5): 2'-O-methyl
  misc_feature (6)..(7): 2'-deoxy-2'Fluoro
  misc_feature (8)..(8): 2'-O-methyl
  misc_feature (9)..(9): 2'-deoxy-2'Fluoro
  misc_feature (10)..(11): 2'-O-methyl
  misc_feature (12)..(12): 2'-deoxy-2'Fluoro
  misc_feature (13)..(15): 2'-O-methyl
  misc_feature (16)..(17): 2'-deoxy-2'Fluoro
  misc_feature (18)..(18): 2'-O-methyl
  misc_feature (19)..(19): 2'-deoxy-2'Fluoro
  misc_feature (1)..(19): ribonucleotide unmodified or modified as described for this sequence
gaacaccaugacggacuautt

SEQ ID NO: 1594 - DNA, 21 bp, Artificial Sequence
  Description of Artificial Sequence: Target Sequence/siNA antisense region (stab08)
  misc_feature (20)..(20): Phosphorothioate or Phosphorodithioate 3'-Internucleotide Linkage (optionally present)
  misc_feature (2)..(3): 2'-deoxy-2'Fluoro
  misc_feature (4)..(4): 2'-O-methyl
  misc_feature (5)..(5): 2'-deoxy-2'Fluoro
  misc_feature (6)..(7): 2'-O-methyl
  misc_feature (8)..(8): 2'-deoxy-2'Fluoro
  misc_feature (9)..(11): 2'-O-methyl
  misc_feature (12)..(13): 2'-deoxy-2'Fluoro
  misc_feature (14)..(14): 2'-O-methyl
  misc_feature (15)..(18): 2'-deoxy-2'Fluoro
  misc_feature (19)..(19): 2'-O-methyl
  misc_feature (1)..(19): ribonucleotide unmodified or modified as described for this sequence
accaugacggacuaucccatt

SEQ ID NO: 1595 - DNA, 21 bp, Artificial Sequence
  Description of Artificial Sequence: Target Sequence/siNA antisense region (stab08)
  misc_feature (20)..(20): Phosphorothioate or Phosphorodithioate 3'-Internucleotide Linkage (optionally present)
  misc_feature (1)..(2): 2'-deoxy-2'Fluoro
  misc_feature (3)..(3): 2'-O-methyl
  misc_feature (4)..(4): 2'-deoxy-2'Fluoro
  misc_feature (5)..(6): 2'-O-methyl
  misc_feature (7)..(7): 2'-deoxy-2'Fluoro
  misc_feature (8)..(10): 2'-O-methyl
  misc_feature (11)..(12): 2'-deoxy-2'Fluoro
  misc_feature (13)..(13): 2'-O-methyl
  misc_feature (14)..(17): 2'-deoxy-2'Fluoro
  misc_feature (18)..(18): 2'-O-methyl
  misc_feature (19)..(19): 2'-deoxy-2'Fluoro
  misc_feature (1)..(19): ribonucleotide unmodified or modified as described for this sequence
ccaugacggacuaucccactt

SEQ ID NO: 1596 - DNA, 21 bp, Artificial Sequence
  Description of Artificial Sequence: Target Sequence/siNA antisense region (stab08)
  misc_feature (20)..(20): Phosphorothioate or Phosphorodithioate 3'-Internucleotide Linkage (optionally present)
  misc_feature (1)..(1): 2'-deoxy-2'Fluoro
  misc_feature (2)..(2): 2'-O-methyl
  misc_feature (3)..(3): 2'-deoxy-2'Fluoro
  misc_feature (4)..(5): 2'-O-methyl
  misc_feature (6)..(6): 2'-deoxy-2'Fluoro
  misc_feature (7)..(9): 2'-O-methyl
  misc_feature (10)..(11): 2'-deoxy-2'Fluoro
  misc_feature (12)..(12): 2'-O-methyl
  misc_feature (13)..(16): 2'-deoxy-2'Fluoro
  misc_feature (17)..(17): 2'-O-methyl
  misc_feature (18)..(18): 2'-deoxy-2'Fluoro
  misc_feature (19)..(19): 2'-O-methyl
  misc_feature (1)..(19): ribonucleotide unmodified or modified as described for this sequence
caugacggacuaucccacgtt

SEQ ID NO: 1597 - DNA, 21 bp, Artificial Sequence
  Description of Artificial Sequence: Target Sequence/siNA antisense region (stab08)
  misc_feature (20)..(20): Phosphorothioate or Phosphorodithioate 3'-Internucleotide Linkage (optionally present)
  misc_feature (2)..(2): 2'-deoxy-2'Fluoro
  misc_feature (3)..(4): 2'-O-methyl
  misc_feature (5)..(5): 2'-deoxy-2'Fluoro
  misc_feature (6)..(8): 2'-O-methyl
  misc_feature (9)..(10): 2'-deoxy-2'Fluoro
  misc_feature (11)..(11): 2'-O-methyl
  misc_feature (12)..(15): 2'-deoxy-2'Fluoro
  misc_feature (16)..(16): 2'-O-methyl
  misc_feature (17)..(17): 2'-deoxy-2'Fluoro
  misc_feature (18)..(19): 2'-O-methyl
  misc_feature (1)..(19): ribonucleotide unmodified or modified as described for this sequence
augacggacuaucccacgatt

SEQ ID NO: 1598 - DNA, 21 bp, Artificial Sequence
  Description of Artificial Sequence: Target Sequence/siNA antisense region (stab08)
  misc_feature (20)..(20): Phosphorothioate or Phosphorodithioate 3'-Internucleotide Linkage (optionally present)
  misc_feature (3)..(3): 2'-deoxy-2'Fluoro
  misc_feature (4)..(6): 2'-O-methyl
  misc_feature (7)..(8): 2'-deoxy-2'Fluoro
  misc_feature (9)..(9): 2'-O-methyl
  misc_feature (10)..(13): 2'-deoxy-2'Fluoro
  misc_feature (14)..(14): 2'-O-methyl
  misc_feature (15)..(15): 2'-deoxy-2'Fluoro
  misc_feature (16)..(18): 2'-O-methyl
  misc_feature (19)..(19): 2'-deoxy-2'Fluoro
  misc_feature (1)..(19): ribonucleotide unmodified or modified as described for this sequence
gacggacuaucccacgaactt

SEQ ID NO: 1599 - DNA, 21 bp, Artificial Sequence
  Description of Artificial Sequence: Target Sequence/siNA antisense region (stab08)
  misc_feature (20)..(20): Phosphorothioate or Phosphorodithioate 3'-Internucleotide Linkage (optionally present)
  misc_feature (2)..(2): 2'-deoxy-2'Fluoro
  misc_feature (3)..(5): 2'-O-methyl
  misc_feature (6)..(7): 2'-deoxy-2'Fluoro
  misc_feature (8)..(8): 2'-O-methyl
  misc_feature (9)..(12): 2'-deoxy-2'Fluoro
  misc_feature (13)..(13): 2'-O-methyl
  misc_feature (14)..(14): 2'-deoxy-2'Fluoro
  misc_feature (15)..(17): 2'-O-methyl
  misc_feature (18)..(18): 2'-deoxy-2'Fluoro
  misc_feature (19)..(19): 2'-O-methyl
  misc_feature (1)..(19): ribonucleotide unmodified or modified as described for this sequence
acggacuaucccacgaacgtt

SEQ ID NO: 1600 - DNA, 21 bp, Artificial Sequence
  Description of Artificial Sequence: Target Sequence/siNA antisense region (stab08)
  misc_feature (20)..(20): Phosphorothioate or Phosphorodithioate 3'-Internucleotide Linkage (optionally present)
  misc_feature (4)..(5): 2'-deoxy-2'Fluoro
  misc_feature (6)..(6): 2'-O-methyl
  misc_feature (7)..(10): 2'-deoxy-2'Fluoro
  misc_feature (11)..(11): 2'-O-methyl
  misc_feature (12)..(12): 2'-deoxy-2'Fluoro
  misc_feature (13)..(15): 2'-O-methyl
  misc_feature (16)..(16): 2'-deoxy-2'Fluoro
  misc_feature (17)..(17): 2'-O-methyl
  misc_feature (18)..(19): 2'-deoxy-2'Fluoro
  misc_feature (1)..(19): ribonucleotide unmodified or modified as described for this sequence
ggacuaucccacgaacgcutt

SEQ ID NO: 1601 - DNA, 21 bp, Artificial Sequence
  Description of Artificial Sequence: Target Sequence/siNA antisense region (stab08)
  misc_feature (20)..(20): Phosphorothioate or Phosphorodithioate 3'-Internucleotide Linkage (optionally present)
  misc_feature (1)..(2): 2'-deoxy-2'Fluoro
  misc_feature (3)..(3): 2'-O-methyl
  misc_feature (4)..(7): 2'-deoxy-2'Fluoro
  misc_feature (8)..(8): 2'-O-methyl
  misc_feature (9)..(9): 2'-deoxy-2'Fluoro
  misc_feature (10)..(12): 2'-O-methyl
  misc_feature (13)..(13): 2'-deoxy-2'Fluoro
  misc_feature (14)..(14): 2'-O-methyl
  misc_feature (15)..(17): 2'-deoxy-2'Fluoro
  misc_feature (18)..(18): 2'-O-methyl
  misc_feature (19)..(19): 2'-deoxy-2'Fluoro
  misc_feature (1)..(19): ribonucleotide unmodified or modified as described for this sequence
cuaucccacgaacgcucactt

SEQ ID NO: 1602 - DNA, 21 bp, Artificial Sequence
  Description of Artificial Sequence: Target Sequence/siNA antisense region (stab08)
  misc_feature (20)..(20): Phosphorothioate or Phosphorodithioate 3'-Internucleotide Linkage (optionally present)
  misc_feature (1)..(1): 2'-deoxy-2'Fluoro
  misc_feature (2)..(5): 2'-O-methyl
  misc_feature (6)..(11): 2'-deoxy-2'Fluoro
  misc_feature (12)..(15): 2'-O-methyl
  misc_feature (16)..(16): 2'-deoxy-2'Fluoro
  misc_feature (17)..(17): 2'-O-methyl
  misc_feature (18)..(19): 2'-deoxy-2'Fluoro
  misc_feature (1)..(19): ribonucleotide unmodified or modified as described for this sequence
cggggcccuccagagcauctt

SEQ ID NO: 1603 - DNA, 21 bp, Artificial Sequence
  Description of Artificial Sequence: Target Sequence/siNA sense region (stab04)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(4): 2'-deoxy-2'Fluoro
  misc_feature (11)..(14): 2'-deoxy-2'Fluoro
  misc_feature (16)..(16): 2'-deoxy-2'Fluoro
  misc_feature (1)..(19): ribonucleotide unmodified or modified as described for this sequence
ccccgggaggucucguagatt

SEQ ID NO: 1604 - DNA, 21 bp, Artificial Sequence
  Description of Artificial Sequence: Target Sequence/siNA sense region (stab04)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (4)..(4): 2'-deoxy-2'Fluoro
  misc_feature (6)..(9): 2'-deoxy-2'Fluoro
  misc_feature (16)..(19): 2'-deoxy-2'Fluoro
  misc_feature (1)..(19): ribonucleotide unmodified or modified as described for this sequence
agaugcucuggagggcccctt

SEQ ID NO: 1605 - DNA, 21 bp, Artificial Sequence
  Description of Artificial Sequence: Target Sequence/siNA antisense region (stab05)
  misc_feature (20)..(20): Phosphorothioate or Phosphorodithioate 3'-Internucleotide Linkage (optionally present)
  misc_feature (1)..(3): 2'-deoxy-2'Fluoro
  misc_feature (5)..(5): 2'-deoxy-2'Fluoro
  misc_feature (10)..(15): 2'-deoxy-2'Fluoro
  misc_feature (1)..(19): ribonucleotide unmodified or modified as described for this sequence
ucuacgagaccucccggggtt

SEQ ID NO: 1606 - DNA, 21 bp, Artificial Sequence
  Description of Artificial Sequence: Target Sequence/siNA antisense region (stab05)
  misc_feature (20)..(20): Phosphorothioate or Phosphorodithioate 3'-Internucleotide Linkage (optionally present)
  misc_feature (5)..(10): 2'-deoxy-2'Fluoro
  misc_feature (15)..(15): 2'-deoxy-2'Fluoro
  misc_feature (17)..(19): 2'-deoxy-2'Fluoro
  misc_feature (1)..(19): ribonucleotide unmodified or modified as described for this sequence
ggggcccuccagagcaucutt

SEQ ID NO: 1607 - DNA, 21 bp, Artificial Sequence
  Description of Artificial Sequence: Target Sequence/siNA sense region (stab07)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(4): 2'-deoxy-2'Fluoro
  misc_feature (5)..(10): 2'-deoxy
  misc_feature (11)..(14): 2'-deoxy-2'Fluoro
  misc_feature (15)..(15): 2'-deoxy
  misc_feature (16)..(16): 2'-deoxy-2'Fluoro
  misc_feature (17)..(19): 2'-deoxy
  misc_feature (1)..(19): ribonucleotide unmodified or modified as described for this sequence
ccccgggaggucucguagatt

SEQ ID NO: 1608 - DNA, 21 bp, Artificial Sequence
  Description of Artificial Sequence: Target Sequence/siNA sense region (stab07)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(3): 2'-deoxy
  misc_feature (4)..(4): 2'-deoxy-2'Fluoro
  misc_feature (5)..(5): 2'-deoxy
  misc_feature (6)..(9): 2'-deoxy-2'Fluoro
  misc_feature (10)..(15): 2'-deoxy
  misc_feature (16)..(19): 2'-deoxy-2'Fluoro
  misc_feature (1)..(19): ribonucleotide unmodified or modified as described for this sequence
agaugcucuggagggcccctt

SEQ ID NO: 1609 - DNA, 21 bp, Artificial Sequence
  Description of Artificial Sequence: Target Sequence/siNA antisense region (stab08)
  misc_feature (20)..(20): Phosphorothioate or Phosphorodithioate 3'-Internucleotide Linkage (optionally present)
  misc_feature (5)..(10): 2'-deoxy-2'Fluoro
  misc_feature (11)..(14): 2'-O-methyl
  misc_feature (15)..(15): 2'-deoxy-2'Fluoro
  misc_feature (16)..(16): 2'-O-methyl
  misc_feature (17)..(19): 2'-deoxy-2'Fluoro
  misc_feature (1)..(19): ribonucleotide unmodified or modified as described for this sequence
ggggcccuccagagcaucutt

SEQ ID NO: 1610 - DNA, 21 bp, Artificial Sequence
  Description of Artificial Sequence: Target Sequence/siNA antisense region (stab11)
  misc_feature (20)..(20): Phosphorothioate or Phosphorodithioate 3'-Internucleotide Linkage (optionally present)
  misc_feature (1)..(3): 2'-deoxy-2'Fluoro
  misc_feature (5)..(5): 2'-deoxy-2'Fluoro
  misc_feature (10)..(15): 2'-deoxy-2'Fluoro
  misc_feature (1)..(19): ribonucleotide unmodified or modified as described for this sequence
ucuacgagaccucccggggtt

SEQ ID NO: 1611 - DNA, 21 bp, Artificial Sequence
  Description of Artificial Sequence: Target Sequence/siNA antisense region (stab11)
  misc_feature (20)..(20): Phosphorothioate or Phosphorodithioate 3'-Internucleotide Linkage (optionally present)
  misc_feature (5)..(10): 2'-deoxy-2'Fluoro
  misc_feature (11)..(14): 2'-deoxy
  misc_feature (15)..(15): 2'-deoxy-2'Fluoro
  misc_feature (16)..(16): 2'-deoxy
  misc_feature (17)..(19): 2'-deoxy-2'Fluoro
  misc_feature (1)..(19): ribonucleotide unmodified or modified as described for this sequence
ggggcccuccagagcaucutt

SEQ ID NO: 1612 - DNA, 21 bp, Artificial Sequence
  Description of Artificial Sequence: Target Sequence/siNA sense region (stab04)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (3)..(3): 2'-deoxy-2'Fluoro
  misc_feature (6)..(8): 2'-deoxy-2'Fluoro
  misc_feature (10)..(10): 2'-deoxy-2'Fluoro
  misc_feature (15)..(16): 2'-deoxy-2'Fluoro
  misc_feature (19)..(19): 2'-deoxy-2'Fluoro
  misc_feature (1)..(19): ribonucleotide unmodified or modified as described for this sequence
aguggucugcggaaccggutt

SEQ ID NO: 1613 - DNA, 21 bp, Artificial Sequence
  Description of Artificial Sequence: Target Sequence/siNA sense region (stab04)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(2): 2'-deoxy-2'Fluoro
  misc_feature (4)..(4): 2'-deoxy-2'Fluoro
  misc_feature (9)..(10): 2'-deoxy-2'Fluoro
  misc_feature (13)..(13): 2'-deoxy-2'Fluoro
  misc_feature (17)..(17): 2'-deoxy-2'Fluoro
  misc_feature (19)..(19): 2'-deoxy-2'Fluoro
  misc_feature (1)..(19): ribonucleotide unmodified or modified as described for this sequence
cugcggaaccggugaguactt

SEQ ID NO: 1614 - DNA, 21 bp, Artificial Sequence
  Description of Artificial Sequence: Target Sequence/siNA sense region (stab04)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (4)..(7): 2'-deoxy-2'Fluoro
  misc_feature (9)..(9): 2'-deoxy-2'Fluoro
  misc_feature (12)..(12): 2'-deoxy-2'Fluoro
  misc_feature (14)..(15): 2'-deoxy-2'Fluoro
  misc_feature (17)..(19): 2'-deoxy-2'Fluoro
  misc_feature (1)..(19): ribonucleotide unmodified or modified as described for this sequence
aggccuugugguacugccutt

SEQ ID NO: 1615 - DNA, 21 bp, Artificial Sequence
  Description of Artificial Sequence: Target Sequence/siNA sense region (stab04)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(3): 2'-deoxy-2'Fluoro
  misc_feature (5)..(5): 2'-deoxy-2'Fluoro
  misc_feature (8)..(8): 2'-deoxy-2'Fluoro
  misc_feature (10)..(11): 2'-deoxy-2'Fluoro
  misc_feature (13)..(15): 2'-deoxy-2'Fluoro
  misc_feature (18)..(18): 2'-deoxy-2'Fluoro
  misc_feature (1)..(19): ribonucleotide unmodified or modified as described for this sequence
cuugugguacugccugauatt

SEQ ID NO: 1616 - DNA, 21 bp, Artificial Sequence
  Description of Artificial Sequence: Target Sequence/siNA sense region (stab04)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(1): 2'-deoxy-2'Fluoro
  misc_feature (4)..(4): 2'-deoxy-2'Fluoro
  misc_feature (6)..(7): 2'-deoxy-2'Fluoro
  misc_feature (9)..(11): 2'-deoxy-2'Fluoro
  misc_feature (14)..(14): 2'-deoxy-2'Fluoro
  misc_feature (19)..(19): 2'-deoxy-2'Fluoro
  misc_feature (1)..(19): ribonucleotide unmodified or modified as described for this sequence
ugguacugccugauagggutt

SEQ ID NO: 1617 - DNA, 21 bp, Artificial Sequence
  Description of Artificial Sequence: Target Sequence/siNA sense region (stab04)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (3)..(3): 2'-deoxy-2'Fluoro
  misc_feature (5)..(6): 2'-deoxy-2'Fluoro
  misc_feature (8)..(10): 2'-deoxy-2'Fluoro
  misc_feature (13)..(13): 2'-deoxy-2'Fluoro
  misc_feature (18)..(18): 2'-deoxy-2'Fluoro
  misc_feature (1)..(19): ribonucleotide unmodified or modified as described for this sequence
gguacugccugauagggugtt

SEQ ID NO: 1618 - DNA, 21 bp, Artificial Sequence
  Description of Artificial Sequence: Target Sequence/siNA sense region (stab04)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (2)..(2): 2'-deoxy-2'Fluoro
  misc_feature (4)..(5): 2'-deoxy-2'Fluoro
  misc_feature (7)..(9): 2'-deoxy-2'Fluoro
  misc_feature (12)..(12): 2'-deoxy-2'Fluoro
  misc_feature (17)..(17): 2'-deoxy-2'Fluoro
  misc_feature (19)..(19): 2'-deoxy-2'Fluoro
  misc_feature (1)..(19): ribonucleotide unmodified or modified as described for this sequence
guacugccugauagggugctt

SEQ ID NO: 1619 - DNA, 21 bp, Artificial Sequence
  Description of Artificial Sequence: Target Sequence/siNA sense region (stab04)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(1): 2'-deoxy-2'Fluoro
  misc_feature (3)..(4): 2'-deoxy-2'Fluoro
  misc_feature (6)..(8): 2'-deoxy-2'Fluoro
  misc_feature (11)..(11): 2'-deoxy-2'Fluoro
  misc_feature (16)..(16): 2'-deoxy-2'Fluoro
  misc_feature (18)..(19): 2'-deoxy-2'Fluoro
  misc_feature (1)..(19): ribonucleotide unmodified or modified as described for this sequence
uacugccugauagggugcutt

SEQ ID NO: 1620 - DNA, 21 bp, Artificial Sequence
  Description of Artificial Sequence: Target Sequence/siNA sense region (stab04)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(2): 2'-deoxy-2'Fluoro
  misc_feature (4)..(6): 2'-deoxy-2'Fluoro
  misc_feature (9)..(9): 2'-deoxy-2'Fluoro
  misc_feature (14)..(14): 2'-deoxy-2'Fluoro
  misc_feature (16)..(18): 2'-deoxy-2'Fluoro
  misc_feature (1)..(19): ribonucleotide unmodified or modified as described for this sequence
cugccugauagggugcuugtt

SEQ ID NO: 1621 - DNA, 21 bp, Artificial Sequence
  Description of Artificial Sequence: Target Sequence/siNA sense region (stab04)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(1): 2'-deoxy-2'Fluoro
  misc_feature (3)..(5): 2'-deoxy-2'Fluoro
  misc_feature (8)..(8): 2'-deoxy-2'Fluoro
  misc_feature (13)..(13): 2'-deoxy-2'Fluoro
  misc_feature (15)..(17): 2'-deoxy-2'Fluoro
  misc_feature (19)..(19): 2'-deoxy-2'Fluoro
  misc_feature (1)..(19): ribonucleotide unmodified or modified as described for this sequence
ugccugauagggugcuugctt

SEQ ID NO: 1622 - DNA, 21 bp, Artificial Sequence
  Description of Artificial Sequence: Target Sequence/siNA sense region (stab04)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(3): 2'-deoxy-2'Fluoro
  misc_feature (6)..(6): 2'-deoxy-2'Fluoro
  misc_feature (11)..(11): 2'-deoxy-2'Fluoro
  misc_feature (13)..(15): 2'-deoxy-2'Fluoro
  misc_feature (17)..(17): 2'-deoxy-2'Fluoro
  misc_feature (1)..(19): ribonucleotide unmodified or modified as described for this sequence
ccugauagggugcuugcgatt

SEQ ID NO: 1623 - DNA, 21 bp, Artificial Sequence
  Description of Artificial Sequence: Target Sequence/siNA sense region (stab04)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (3)..(3): 2'-deoxy-2'Fluoro
  misc_feature (8)..(8): 2'-deoxy-2'Fluoro
  misc_feature (10)..(12): 2'-deoxy-2'Fluoro
  misc_feature (14)..(14): 2'-deoxy-2'Fluoro
  misc_feature (18)..(18): 2'-deoxy-2'Fluoro
  misc_feature (1)..(19): ribonucleotide unmodified or modified as described for this sequence
gauagggugcuugcgagugtt

SEQ ID NO: 1624 - DNA, 21 bp, Artificial Sequence
  Description of Artificial Sequence: Target Sequence/siNA antisense region (stab05)
  misc_feature (20)..(20): Phosphorothioate or Phosphorodithioate 3'-Internucleotide Linkage (optionally present)
  misc_feature (2)..(3): 2'-deoxy-2'Fluoro
  misc_feature (6)..(9): 2'-deoxy-2'Fluoro
  misc_feature (11)..(11): 2'-deoxy-2'Fluoro
  misc_feature (15)..(16): 2'-deoxy-2'Fluoro
  misc_feature (18)..(19): 2'-deoxy-2'Fluoro
  misc_feature (1)..(19): ribonucleotide unmodified or modified as described for this sequence
accgguuccgcagaccacutt

SEQ ID NO: 1625 - DNA, 21 bp, Artificial Sequence
  Description of Artificial Sequence: Target Sequence/siNA antisense region (stab05)
  misc_feature (20)..(20): Phosphorothioate or Phosphorodithioate 3'-Internucleotide Linkage (optionally present)
  misc_feature (2)..(2): 2'-deoxy-2'Fluoro
  misc_feature (4)..(6): 2'-deoxy-2'Fluoro
  misc_feature (8)..(9): 2'-deoxy-2'Fluoro
  misc_feature (12)..(15): 2'-deoxy-2'Fluoro
  misc_feature (17)..(17): 2'-deoxy-2'Fluoro
  misc_feature (1)..(19): ribonucleotide unmodified or modified as described for this sequence
guacucaccgguuccgcagtt

SEQ ID NO: 1626 - DNA, 21 bp, Artificial Sequence
  Description of Artificial Sequence: Target Sequence/siNA antisense region (stab05)
  misc_feature (20)..(20): Phosphorothioate or Phosphorodithioate 3'-Internucleotide Linkage (optionally present)
  misc_feature (4)..(4): 2'-deoxy-2'Fluoro
  misc_feature (7)..(7): 2'-deoxy-2'Fluoro
  misc_feature (9)..(10): 2'-deoxy-2'Fluoro
  misc_feature (12)..(12): 2'-deoxy-2'Fluoro
  misc_feature (17)..(19): 2'-deoxy-2'Fluoro
  misc_feature (1)..(19): ribonucleotide unmodified or modified as described for this sequence
aggcaguaccacaaggccutt

SEQ ID NO: 1627 - DNA, 21 bp, Artificial Sequence
  Description of Artificial Sequence: Target Sequence/siNA antisense region (stab05)
  misc_feature (20)..(20): Phosphorothioate or Phosphorodithioate 3'-Internucleotide Linkage (optionally present)
  misc_feature (1)..(1): 2'-deoxy-2'Fluoro
  misc_feature (3)..(4): 2'-deoxy-2'Fluoro
  misc_feature (8)..(8): 2'-deoxy-2'Fluoro
  misc_feature (11)..(11): 2'-deoxy-2'Fluoro
  misc_feature (13)..(14): 2'-deoxy-2'Fluoro
  misc_feature (16)..(16): 2'-deoxy-2'Fluoro
  misc_feature (1)..(19): ribonucleotide unmodified or modified as described for this sequence
uaucaggcaguaccacaagtt

SEQ ID NO: 1628 - DNA, 21 bp, Artificial Sequence
  Description of Artificial Sequence: Target Sequence/siNA antisense region (stab05)
  misc_feature (20)..(20): Phosphorothioate or Phosphorodithioate 3'-Internucleotide Linkage (optionally present)
  misc_feature (2)..(5): 2'-deoxy-2'Fluoro
  misc_feature (7)..(8): 2'-deoxy-2'Fluoro
  misc_feature (12)..(12): 2'-deoxy-2'Fluoro
  misc_feature (15)..(15): 2'-deoxy-2'Fluoro
  misc_feature (17)..(18): 2'-deoxy-2'Fluoro
  misc_feature (1)..(19): ribonucleotide unmodified or modified as described for this sequence
acccuaucaggcaguaccatt

SEQ ID NO: 1629 - DNA, 21 bp, Artificial Sequence
  Description of Artificial Sequence: Target Sequence/siNA antisense region (stab05)
  misc_feature (20)..(20): Phosphorothioate or Phosphorodithioate 3'-Internucleotide Linkage (optionally present)
  misc_feature (1)..(1): 2'-deoxy-2'Fluoro
  misc_feature (3)..(6): 2'-deoxy-2'Fluoro
  misc_feature (8)..(9): 2'-deoxy-2'Fluoro
  misc_feature (13)..(13): 2'-deoxy-2'Fluoro
  misc_feature (16)..(16): 2'-deoxy-2'Fluoro
  misc_feature (18)..(19): 2'-deoxy-2'Fluoro
  misc_feature (1)..(19): ribonucleotide unmodified or modified as described for this sequence
cacccuaucaggcaguacctt

SEQ ID NO: 1630 - DNA, 21 bp, Artificial Sequence
  Description of Artificial Sequence: Target Sequence/siNA antisense region (stab05)
  misc_feature (20)..(20): Phosphorothioate or Phosphorodithioate 3'-Internucleotide Linkage (optionally present)
  misc_feature (2)..(2): 2'-deoxy-2'Fluoro
  misc_feature (4)..(7): 2'-deoxy-2'Fluoro
  misc_feature (9)..(10): 2'-deoxy-2'Fluoro
  misc_feature (14)..(14): 2'-deoxy-2'Fluoro
  misc_feature (17)..(17): 2'-deoxy-2'Fluoro
  misc_feature (19)..(19): 2'-deoxy-2'Fluoro
  misc_feature (1)..(19): ribonucleotide unmodified or modified as described for this sequence
gcacccuaucaggcaguactt

SEQ ID NO: 1631 - DNA, 21 bp, Artificial Sequence
  Description of Artificial Sequence: Target Sequence/siNA antisense region (stab05)
  misc_feature (20)..(20): Phosphorothioate or Phosphorodithioate 3'-Internucleotide Linkage (optionally present)
  misc_feature (3)..(3): 2'-deoxy-2'Fluoro
  misc_feature (5)..(8): 2'-deoxy-2'Fluoro
  misc_feature (10)..(11): 2'-deoxy-2'Fluoro
  misc_feature (15)..(15): 2'-deoxy-2'Fluoro
  misc_feature (18)..(18): 2'-deoxy-2'Fluoro
  misc_feature (1)..(19): ribonucleotide unmodified or modified as described for this sequence
agcacccuaucaggcaguatt

SEQ ID NO: 1632 - DNA, 21 bp, Artificial Sequence
  Description of Artificial Sequence: Target Sequence/siNA antisense region (stab05)
  misc_feature (20)..(20): Phosphorothioate or Phosphorodithioate 3'-Internucleotide Linkage (optionally present)
  misc_feature (1)..(1): 2'-deoxy-2'Fluoro
  misc_feature (5)..(5): 2'-deoxy-2'Fluoro
  misc_feature (7)..(10): 2'-deoxy-2'Fluoro
  misc_feature (12)..(13): 2'-deoxy-2'Fluoro
  misc_feature (17)..(17): 2'-deoxy-2'Fluoro
  misc_feature (1)..(19): ribonucleotide unmodified or modified as described for this sequence
caagcacccuaucaggcagtt

SEQ ID NO: 1633 - DNA, 21 bp, Artificial Sequence
  Description of Artificial Sequence: Target Sequence/siNA antisense region (stab05)
  misc_feature (20)..(20): Phosphorothioate or Phosphorodithioate 3'-Internucleotide Linkage (optionally present)
  misc_feature (2)..(2): 2'-deoxy-2'Fluoro
  misc_feature (6)..(6): 2'-deoxy-2'Fluoro
  misc_feature (8)..(11): 2'-deoxy-2'Fluoro
  misc_feature (13)..(14): 2'-deoxy-2'Fluoro
  misc_feature (18)..(18): 2'-deoxy-2'Fluoro
  misc_feature (1)..(19): ribonucleotide unmodified or modified as described for this sequence
gcaagcacccuaucaggcatt

SEQ ID NO: 1634 - DNA, 21 bp, Artificial Sequence
  Description of Artificial Sequence: Target Sequence/siNA antisense region (stab05)
  misc_feature (20)..(20): Phosphorothioate or Phosphorodithioate 3'-Internucleotide Linkage (optionally present)
  misc_feature (1)..(2): 2'-deoxy-2'Fluoro
  misc_feature (4)..(4): 2'-deoxy-2'Fluoro
  misc_feature (8)..(8): 2'-deoxy-2'Fluoro
  misc_feature (10)..(13): 2'-deoxy-2'Fluoro
  misc_feature (15)..(16): 2'-deoxy-2'Fluoro
  misc_feature (1)..(19): ribonucleotide unmodified or modified as described for this sequence
ucgcaagcacccuaucaggtt

SEQ ID NO: 1635 - DNA, 21 bp, Artificial Sequence
  Description of Artificial Sequence: Target Sequence/siNA antisense region (stab05)
  misc_feature (20)..(20): Phosphorothioate or Phosphorodithioate 3'-Internucleotide Linkage (optionally present)
  misc_feature (1)..(1): 2'-deoxy-2'Fluoro
  misc_feature (3)..(5): 2'-deoxy-2'Fluoro
  misc_feature (7)..(7): 2'-deoxy-2'Fluoro
  misc_feature (11)..(11): 2'-deoxy-2'Fluoro
  misc_feature (13)..(16): 2'-deoxy-2'Fluoro
  misc_feature (18)..(19): 2'-deoxy-2'Fluoro
  misc_feature (1)..(19): ribonucleotide unmodified or modified as described for this sequence
cacucgcaagcacccuauctt

SEQ ID NO: 1636 - DNA, 21 bp, Artificial Sequence
  Description of Artificial Sequence: Target Sequence/siNA sense region (stab04)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(1): 2'-deoxy-2'Fluoro
  misc_feature (4)..(5): 2'-deoxy-2'Fluoro
  misc_feature (10)..(10): 2'-deoxy-2'Fluoro
  misc_feature (12)..(14): 2'-deoxy-2'Fluoro
  misc_feature (17)..(17): 2'-deoxy-2'Fluoro
  misc_feature (1)..(19): ribonucleotide unmodified or modified as described for this sequence
uggccaaggcgucuggugatt

SEQ ID NO: 1637 - DNA, 21 bp, Artificial Sequence
  Description of Artificial Sequence: Target Sequence/siNA sense region (stab04)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(1): 2'-deoxy-2'Fluoro
  misc_feature (3)..(3): 2'-deoxy-2'Fluoro
  misc_feature (7)..(7): 2'-deoxy-2'Fluoro
  misc_feature (10)..(11): 2'-deoxy-2'Fluoro
  misc_feature (16)..(16): 2'-deoxy-2'Fluoro
  misc_feature (18)..(19): 2'-deoxy-2'Fluoro
  misc_feature (1)..(19): ribonucleotide unmodified or modified as described for this sequence
caugaguggccaaggcguctt

SEQ ID NO: 1638 - DNA, 21 bp, Artificial Sequence
  Description of Artificial Sequence: Target Sequence/siNA sense region (stab04)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(3): 2'-deoxy-2'Fluoro
  misc_feature (5)..(6): 2'-deoxy-2'Fluoro
  misc_feature (8)..(8): 2'-deoxy-2'Fluoro
  misc_feature (11)..(11): 2'-deoxy-2'Fluoro
  misc_feature (13)..(16): 2'-deoxy-2'Fluoro
  misc_feature (1)..(19): ribonucleotide unmodified or modified as described for this sequence
uccgucaugguguuccggatt

SEQ ID NO: 1639 - DNA, 21 bp, Artificial Sequence
  Description of Artificial Sequence: Target Sequence/siNA sense region (stab04)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (2)..(2): 2'-deoxy-2'Fluoro
  misc_feature (5)..(7): 2'-deoxy-2'Fluoro
  misc_feature (9)..(10): 2'-deoxy-2'Fluoro
  misc_feature (12)..(12): 2'-deoxy-2'Fluoro
  misc_feature (15)..(15): 2'-deoxy-2'Fluoro
  misc_feature (17)..(19): 2'-deoxy-2'Fluoro
  misc_feature (1)..(19): ribonucleotide unmodified or modified as described for this sequence
auaguccgucaugguguuctt

SEQ ID NO: 1640 - DNA, 21 bp, Artificial Sequence
  Description of Artificial Sequence: Target Sequence/siNA sense region (stab04)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(1): 2'-deoxy-2'Fluoro
  misc_feature (6)..(6): 2'-deoxy-2'Fluoro
  misc_feature (9)..(11): 2'-deoxy-2'Fluoro
  misc_feature (13)..(14): 2'-deoxy-2'Fluoro
  misc_feature (16)..(16): 2'-deoxy-2'Fluoro
  misc_feature (19)..(19): 2'-deoxy-2'Fluoro
  misc_feature (1)..(19): ribonucleotide unmodified or modified as described for this sequence
ugggauaguccgucauggutt

SEQ ID NO: 1641 - DNA, 21 bp, Artificial Sequence
  Description of Artificial Sequence: Target Sequence/siNA sense region (stab04)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (2)..(2): 2'-deoxy-2'Fluoro
  misc_feature (7)..(7): 2'-deoxy-2'Fluoro
  misc_feature (10)..(12): 2'-deoxy-2'Fluoro
  misc_feature (14)..(15): 2'-deoxy-2'Fluoro
  misc_feature (17)..(17): 2'-deoxy-2'Fluoro
  misc_feature (1)..(19): ribonucleotide unmodified or modified as described for this sequence
gugggauaguccgucauggtt

SEQ ID NO: 1642 - DNA, 21 bp, Artificial Sequence
  Description of Artificial Sequence: Target Sequence/siNA sense region (stab04)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(1): 2'-deoxy-2'Fluoro
  misc_feature (3)..(3): 2'-deoxy-2'Fluoro
  misc_feature (8)..(8): 2'-deoxy-2'Fluoro
  misc_feature (11)..(13): 2'-deoxy-2'Fluoro
  misc_feature (15)..(16): 2'-deoxy-2'Fluoro
  misc_feature (18)..(18): 2'-deoxy-2'Fluoro
  misc_feature (1)..(19): ribonucleotide unmodified or modified as described for this sequence
cgugggauaguccgucaugtt

SEQ ID NO: 1643 - DNA, 21 bp, Artificial Sequence
  Description of Artificial Sequence: Target Sequence/siNA sense region (stab04)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(2): 2'-deoxy-2'Fluoro
  misc_feature (4)..(4): 2'-deoxy-2'Fluoro
  misc_feature (9)..(9): 2'-deoxy-2'Fluoro
  misc_feature (12)..(14): 2'-deoxy-2'Fluoro
  misc_feature (16)..(17): 2'-deoxy-2'Fluoro
  misc_feature (19)..(19): 2'-deoxy-2'Fluoro
  misc_feature (1)..(19): ribonucleotide unmodified or modified as described for this sequence
ucgugggauaguccgucautt

SEQ ID NO: 1644 - DNA, 21 bp, Artificial Sequence
  Description of Artificial Sequence: Target Sequence/siNA sense region (stab04)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (2)..(4): 2'-deoxy-2'Fluoro
  misc_feature (6)..(6): 2'-deoxy-2'Fluoro
  misc_feature (11)..(11): 2'-deoxy-2'Fluoro
  misc_feature (14)..(16): 2'-deoxy-2'Fluoro
  misc_feature (18)..(19): 2'-deoxy-2'Fluoro
  misc_feature (1)..(19): ribonucleotide unmodified or modified as described for this sequence
guucgugggauaguccguctt

SEQ ID NO: 1645 - DNA, 21 bp, Artificial Sequence
  Description of Artificial Sequence: Target Sequence/siNA sense region (stab04)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(1): 2'-deoxy-2'Fluoro
  misc_feature (3)..(5): 2'-deoxy-2'Fluoro
  misc_feature (7)..(7): 2'-deoxy-2'Fluoro
  misc_feature (12)..(12): 2'-deoxy-2'Fluoro
  misc_feature (15)..(17): 2'-deoxy-2'Fluoro
  misc_feature (19)..(19): 2'-deoxy-2'Fluoro
  misc_feature (1)..(19): ribonucleotide unmodified or modified as described for this sequence
cguucgugggauaguccgutt

SEQ ID NO: 1646 - DNA, 21 bp, Artificial Sequence
  Description of Artificial Sequence: Target Sequence/siNA sense region (stab04)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (3)..(3): 2'-deoxy-2'Fluoro
  misc_feature (5)..(7): 2'-deoxy-2'Fluoro
  misc_feature (9)..(9): 2'-deoxy-2'Fluoro
  misc_feature (14)..(14): 2'-deoxy-2'Fluoro
  misc_feature (17)..(19): 2'-deoxy-2'Fluoro
  misc_feature (1)..(19): ribonucleotide unmodified or modified as described for this sequence
agcguucgugggauagucctt

SEQ ID NO: 1647 - DNA, 21 bp, Artificial Sequence
  Description of Artificial Sequence: Target Sequence/siNA sense region (stab04)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (2)..(2): 2'-deoxy-2'Fluoro
  misc_feature (6)..(6): 2'-deoxy-2'Fluoro
  misc_feature (8)..(10): 2'-deoxy-2'Fluoro
  misc_feature (12)..(12): 2'-deoxy-2'Fluoro
  misc_feature (17)..(17): 2'-deoxy-2'Fluoro
  misc_feature (1)..(19): ribonucleotide unmodified or modified as described for this sequence
gugagcguucgugggauagtt

SEQ ID NO: 1648 - DNA, 21 bp, Artificial Sequence
  Description of Artificial Sequence: Target Sequence/siNA antisense region (stab05)
  misc_feature (20)..(20): Phosphorothioate or Phosphorodithioate 3'-Internucleotide Linkage (optionally present)
  misc_feature (1)..(2): 2'-deoxy-2'Fluoro
  misc_feature (4)..(5): 2'-deoxy-2'Fluoro
  misc_feature (9)..(9): 2'-deoxy-2'Fluoro
  misc_feature (11)..(14): 2'-deoxy-2'Fluoro
  misc_feature (17)..(18): 2'-deoxy-2'Fluoro
  misc_feature (1)..(19): ribonucleotide unmodified or modified as described for this sequence
ucaccagacgccuuggccatt

SEQ ID NO: 1649 - DNA, 21 bp, Artificial Sequence
  Description of Artificial Sequence: Target Sequence/siNA antisense region (stab05)
  misc_feature (20)..(20): Phosphorothioate or Phosphorodithioate 3'-Internucleotide Linkage (optionally present)
  misc_feature (2)..(3): 2'-deoxy-2'Fluoro
  misc_feature (5)..(8): 2'-deoxy-2'Fluoro
  misc_feature (11)..(12): 2'-deoxy-2'Fluoro
  misc_feature (14)..(16): 2'-deoxy-2'Fluoro
  misc_feature (18)..(18): 2'-deoxy-2'Fluoro
  misc_feature (1)..(19): ribonucleotide unmodified or modified as described for this sequence
gacgccuuggccacucaugtt

SEQ ID NO: 1650 - DNA, 21 bp, Artificial Sequence
  Description of Artificial Sequence: Target Sequence/siNA antisense region (stab05)
  misc_feature (20)..(20): Phosphorothioate or Phosphorodithioate 3'-Internucleotide Linkage (optionally present)
  misc_feature (1)..(3): 2'-deoxy-2'Fluoro
  misc_feature (8)..(8): 2'-deoxy-2'Fluoro
  misc_feature (10)..(11): 2'-deoxy-2'Fluoro
  misc_feature (13)..(13): 2'-deoxy-2'Fluoro
  misc_feature (16)..(16): 2'-deoxy-2'Fluoro
  misc_feature (1)..(19): ribonucleotide unmodified or modified as described for this sequence
uccggaacaccaugacggatt

SEQ ID NO: 1651 - DNA, 21 bp, Artificial Sequence
  Description of Artificial Sequence: Target Sequence/siNA antisense region (stab05)
  misc_feature (20)..(20): Phosphorothioate or Phosphorodithioate 3'-Internucleotide Linkage (optionally present)
  misc_feature (4)..(4): 2'-deoxy-2'Fluoro
  misc_feature (6)..(7): 2'-deoxy-2'Fluoro
  misc_feature (9)..(9): 2'-deoxy-2'Fluoro
  misc_feature (12)..(12): 2'-deoxy-2'Fluoro
  misc_feature (16)..(17): 2'-deoxy-2'Fluoro
  misc_feature (19)..(19): 2'-deoxy-2'Fluoro
  misc_feature (1)..(19): ribonucleotide unmodified or modified as described for this sequence
gaacaccaugacggacuautt

SEQ ID NO: 1652 - DNA, 21 bp, Artificial Sequence
  Description of Artificial Sequence: Target Sequence/siNA antisense region (stab05)
  misc_feature (20)..(20): Phosphorothioate or Phosphorodithioate 3'-Internucleotide Linkage (optionally present)
  misc_feature (2)..(3): 2'-deoxy-2'Fluoro
  misc_feature (5)..(5): 2'-deoxy-2'Fluoro
  misc_feature (8)..(8): 2'-deoxy-2'Fluoro
  misc_feature (12)..(13): 2'-deoxy-2'Fluoro
  misc_feature (15)..(18): 2'-deoxy-2'Fluoro
  misc_feature (1)..(19): ribonucleotide unmodified or modified as described for this sequence
accaugacggacuaucccatt

SEQ ID NO: 1653 - DNA, 21 bp, Artificial Sequence
  Description of Artificial Sequence: Target Sequence/siNA antisense region (stab05)
  misc_feature (20)..(20): Phosphorothioate or Phosphorodithioate 3'-Internucleotide Linkage (optionally present)
  misc_feature (1)..(2): 2'-deoxy-2'Fluoro
  misc_feature (4)..(4): 2'-deoxy-2'Fluoro
  misc_feature (7)..(7): 2'-deoxy-2'Fluoro
  misc_feature (11)..(12): 2'-deoxy-2'Fluoro
  misc_feature (14)..(17): 2'-deoxy-2'Fluoro
  misc_feature (19)..(19): 2'-deoxy-2'Fluoro
  misc_feature (1)..(19): ribonucleotide unmodified or modified as described for this sequence
ccaugacggacuaucccactt

SEQ ID NO: 1654 - DNA, 21 bp, Artificial Sequence
  Description of Artificial Sequence: Target Sequence/siNA antisense region (stab05)
  misc_feature (20)..(20): Phosphorothioate or Phosphorodithioate 3'-Internucleotide Linkage (optionally present)
  misc_feature (1)..(1): 2'-deoxy-2'Fluoro
  misc_feature (3)..(3): 2'-deoxy-2'Fluoro
  misc_feature (6)..(6): 2'-deoxy-2'Fluoro
  misc_feature (10)..(11): 2'-deoxy-2'Fluoro
  misc_feature (13)..(16): 2'-deoxy-2'Fluoro
  misc_feature (18)..(18): 2'-deoxy-2'Fluoro
  misc_feature (1)..(19): ribonucleotide unmodified or modified as described for this sequence
caugacggacuaucccacgtt

SEQ ID NO: 1655 - DNA, 21 bp, Artificial Sequence
  Description of Artificial Sequence: Target Sequence/siNA antisense region (stab05)
  misc_feature (20)..(20): Phosphorothioate or Phosphorodithioate 3'-Internucleotide Linkage (optionally present)
  misc_feature (2)..(2): 2'-deoxy-2'Fluoro
  misc_feature (5)..(5): 2'-deoxy-2'Fluoro
  misc_feature (9)..(10): 2'-deoxy-2'Fluoro
  misc_feature (12)..(15): 2'-deoxy-2'Fluoro
  misc_feature (17)..(17): 2'-deoxy-2'Fluoro
  misc_feature (1)..(19): ribonucleotide unmodified or modified as described for this sequence
augacggacuaucccacgatt

SEQ ID NO: 1656 - DNA, 21 bp, Artificial Sequence
  Description of Artificial Sequence: Target Sequence/siNA antisense region (stab05)
  misc_feature (20)..(20): Phosphorothioate or Phosphorodithioate 3'-Internucleotide Linkage (optionally present)
  misc_feature (3)..(3): 2'-deoxy-2'Fluoro
  misc_feature (7)..(8): 2'-deoxy-2'Fluoro
  misc_feature (10)..(13): 2'-deoxy-2'Fluoro
  misc_feature (15)..(15): 2'-deoxy-2'Fluoro
  misc_feature (19)..(19): 2'-deoxy-2'Fluoro
  misc_feature (1)..(19): ribonucleotide unmodified or modified as described for this sequence
gacggacuaucccacgaactt

SEQ ID NO: 1657 - DNA, 21 bp, Artificial Sequence
  Description of Artificial Sequence: Target Sequence/siNA antisense region (stab05)
  misc_feature (20)..(20): Phosphorothioate or Phosphorodithioate 3'-Internucleotide Linkage (optionally present)
  misc_feature (2)..(2): 2'-deoxy-2'Fluoro
  misc_feature (6)..(7): 2'-deoxy-2'Fluoro
  misc_feature (9)..(12): 2'-deoxy-2'Fluoro
  misc_feature (14)..(14): 2'-deoxy-2'Fluoro
  misc_feature (18)..(18): 2'-deoxy-2'Fluoro
  misc_feature (1)..(19): ribonucleotide unmodified or modified as described for this sequence
acggacuaucccacgaacgtt

SEQ ID NO: 1658 - DNA, 21 bp, Artificial Sequence
  Description of Artificial Sequence: Target Sequence/siNA antisense region (stab05)
  misc_feature (20)..(20): Phosphorothioate or Phosphorodithioate 3'-Internucleotide Linkage (optionally present)
  misc_feature (4)..(5): 2'-deoxy-2'Fluoro
  misc_feature (7)..(10): 2'-deoxy-2'Fluoro
  misc_feature (12)..(12): 2'-deoxy-2'Fluoro
  misc_feature (16)..(16): 2'-deoxy-2'Fluoro
  misc_feature (18)..(19): 2'-deoxy-2'Fluoro
  misc_feature (1)..(19): ribonucleotide unmodified or modified as described for this sequence
ggacuaucccacgaacgcutt

SEQ ID NO: 1659 - DNA, 21 bp, Artificial Sequence
  Description of Artificial Sequence: Target Sequence/siNA antisense region (stab05)
  misc_feature (20)..(20): Phosphorothioate or Phosphorodithioate 3'-Internucleotide Linkage (optionally present)
  misc_feature (1)..(2): 2'-deoxy-2'Fluoro
  misc_feature (4)..(7): 2'-deoxy-2'Fluoro
  misc_feature (9)..(9): 2'-deoxy-2'Fluoro
  misc_feature (13)..(13): 2'-deoxy-2'Fluoro
  misc_feature (15)..(17): 2'-deoxy-2'Fluoro
  misc_feature (19)..(19): 2'-deoxy-2'Fluoro
  misc_feature (1)..(19): ribonucleotide unmodified or modified as described for this sequence
cuaucccacgaacgcucactt

SEQ ID NO: 1660 - DNA, 21 bp, Artificial Sequence
  Description of Artificial Sequence: Target Sequence/siNA sense region (stab04)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (2)..(10): 2'-deoxy-2'Fluoro
  misc_feature (14)..(15): 2'-deoxy-2'Fluoro
  misc_feature (18)..(19): 2'-deoxy-2'Fluoro
  misc_feature (1)..(19): ribonucleotide unmodified or modified as described for this sequence
guccuuucuuggaucaacctt

SEQ ID NO: 1661 - DNA, 21 bp, Artificial Sequence
  Description of Artificial Sequence: Target Sequence/siNA sense region (stab04)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(9): 2'-deoxy-2'Fluoro
  misc_feature (13)..(14): 2'-deoxy-2'Fluoro
  misc_feature (17)..(19): 2'-deoxy-2'Fluoro
  misc_feature (1)..(19): ribonucleotide unmodified or modified as described for this sequence
uccuuucuuggaucaaccctt

SEQ ID NO: 1662 - DNA, 21 bp, Artificial Sequence
  Description of Artificial Sequence: Target Sequence/siNA sense region (stab04)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (3)..(11): 2'-deoxy-2'Fluoro
  misc_feature (15)..(16): 2'-deoxy-2'Fluoro
  misc_feature (19)..(19): 2'-deoxy-2'Fluoro
  misc_feature (1)..(19): ribonucleotide unmodified or modified as described for this sequence
gguccuuucuuggaucaactt

SEQ ID NO: 1663 - DNA, 21 bp, Artificial Sequence
  Description of Artificial Sequence: Target Sequence/siNA sense region (stab04)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(2): 2'-deoxy-2'Fluoro
  misc_feature (6)..(14): 2'-deoxy-2'Fluoro
  misc_feature (18)..(19): 2'-deoxy-2'Fluoro
  misc_feature (1)..(19): ribonucleotide unmodified or modified as described for this sequence
ccggguccuuucuuggauctt

SEQ ID NO: 1664 - DNA, 21 bp, Artificial Sequence
  Description of Artificial Sequence: Target Sequence/siNA antisense region (stab05)
  misc_feature (20)..(20): Phosphorothioate or Phosphorodithioate 3'-Internucleotide Linkage (optionally present)
  misc_feature (3)..(4): 2'-deoxy-2'Fluoro
  misc_feature (7)..(9): 2'-deoxy-2'Fluoro
  misc_feature (19)..(19): 2'-deoxy-2'Fluoro
  misc_feature (1)..(19): ribonucleotide unmodified or modified as described for this sequence
gguugauccaagaaaggactt

SEQ ID NO: 1665 - DNA, 21 bp, Artificial Sequence
  Description of Artificial Sequence: Target Sequence/siNA antisense region (stab05)
  misc_feature (20)..(20): Phosphorothioate or Phosphorodithioate 3'-Internucleotide Linkage (optionally present)
  misc_feature (4)..(5): 2'-deoxy-2'Fluoro
  misc_feature (8)..(10): 2'-deoxy-2'Fluoro
  misc_feature (1)..(19): ribonucleotide unmodified or modified as described for this sequence
ggguugauccaagaaaggatt

SEQ ID NO: 1666 - DNA, 21 bp, Artificial Sequence
  Description of Artificial Sequence: Target Sequence/siNA antisense region (stab05)
  misc_feature (20)..(20): Phosphorothioate or Phosphorodithioate 3'-Internucleotide Linkage (optionally present)
  misc_feature (2)..(3): 2'-deoxy-2'Fluoro
  misc_feature (6)..(8): 2'-deoxy-2'Fluoro
  misc_feature (18)..(19): 2'-deoxy-2'Fluoro
  misc_feature (1)..(19): ribonucleotide unmodified or modified as described for this sequence
guugauccaagaaaggacctt

SEQ ID NO: 1667 - DNA, 21 bp, Artificial Sequence
  Description of Artificial Sequence: Target Sequence/siNA antisense region (stab05)
  misc_feature (20)..(20): Phosphorothioate or Phosphorodithioate 3'-Internucleotide Linkage (optionally present)
  misc_feature (3)..(5): 2'-deoxy-2'Fluoro
  misc_feature (15)..(17): 2'-deoxy-2'Fluoro
  misc_feature (1)..(19): ribonucleotide unmodified or modified as described for this sequence
gauccaagaaaggacccggtt

SEQ ID NO: 1668 - DNA, 21 bp, Artificial Sequence
  Description of Artificial Sequence: Target Sequence/siNA sense region (stab04)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(2): 2'-deoxy-2'Fluoro
  misc_feature (5)..(6): 2'-deoxy-2'Fluoro
  misc_feature (10)..(18): 2'-deoxy-2'Fluoro
  misc_feature (1)..(19): ribonucleotide unmodified or modified as described for this sequence
ccaacuagguucuuuccugtt

SEQ ID NO: 1669 - DNA, 21 bp, Artificial Sequence
  Description of Artificial Sequence: Target Sequence/siNA sense region (stab04)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(3): 2'-deoxy-2'Fluoro
  misc_feature (6)..(7): 2'-deoxy-2'Fluoro
  misc_feature (11)..(19): 2'-deoxy-2'Fluoro
  misc_feature (1)..(19): ribonucleotide unmodified or modified as described for this sequence
cccaacuagguucuuuccutt

SEQ ID NO: 1670 - DNA, 21 bp, Artificial Sequence
  Description of Artificial Sequence: Target Sequence/siNA sense region (stab04)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(1): 2'-deoxy-2'Fluoro
  misc_feature (4)..(5): 2'-deoxy-2'Fluoro
  misc_feature (9)..(17): 2'-deoxy-2'Fluoro
  misc_feature (1)..(19): ribonucleotide unmodified or modified as described for this sequence
caacuagguucuuuccuggtt

SEQ ID NO: 1671 - DNA, 21 bp, Artificial Sequence
  Description of Artificial Sequence: Target Sequence/siNA sense region (stab04)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(2): 2'-deoxy-2'Fluoro
  misc_feature (6)..(14): 2'-deoxy-2'Fluoro
  misc_feature (18)..(19): 2'-deoxy-2'Fluoro
  misc_feature (1)..(19): ribonucleotide unmodified or modified as described for this sequence
cuagguucuuuccugggcctt

SEQ ID NO: 1672 - DNA, 21 bp, Artificial Sequence
  Description of Artificial Sequence: Target Sequence/siNA antisense region (stab05)
  misc_feature (20)..(20): Phosphorothioate or Phosphorodithioate 3'-Internucleotide Linkage (optionally present)
  misc_feature (1)..(1): 2'-deoxy-2'Fluoro
  misc_feature (11)..(13): 2'-deoxy-2'Fluoro
  misc_feature (16)..(17): 2'-deoxy-2'Fluoro
  misc_feature (1)..(19): ribonucleotide unmodified or modified as described for this sequence
caggaaagaaccuaguuggtt

SEQ ID NO: 1673 - DNA, 21 bp, Artificial Sequence
  Description of Artificial Sequence: Target Sequence/siNA antisense region (stab05)
  misc_feature (20)..(20): Phosphorothioate or Phosphorodithioate 3'-Internucleotide Linkage (optionally present)
  misc_feature (10)..(12): 2'-deoxy-2'Fluoro
  misc_feature (15)..(16): 2'-deoxy-2'Fluoro
  misc_feature (1)..(19): ribonucleotide unmodified or modified as described for this sequence
aggaaagaaccuaguugggtt

SEQ ID NO: 1674 - DNA, 21 bp, Artificial Sequence
  Description of Artificial Sequence: Target Sequence/siNA antisense region (stab05)
  misc_feature (20)..(20): Phosphorothioate or Phosphorodithioate 3'-Internucleotide Linkage (optionally present)
  misc_feature (1)..(2): 2'-deoxy-2'Fluoro
  misc_feature (12)..(14): 2'-deoxy-2'Fluoro
  misc_feature (17)..(18): 2'-deoxy-2'Fluoro
  misc_feature (1)..(19): ribonucleotide unmodified or modified as described for this sequence
ccaggaaagaaccuaguugtt

SEQ ID NO: 1675 - DNA, 21 bp, Artificial Sequence
  Description of Artificial Sequence: Target Sequence/siNA antisense region (stab05)
  misc_feature (20)..(20): Phosphorothioate or Phosphorodithioate 3'-Internucleotide Linkage (optionally present)
  misc_feature (3)..(5): 2'-deoxy-2'Fluoro
  misc_feature (15)..(17): 2'-deoxy-2'Fluoro
  misc_feature (1)..(19): ribonucleotide unmodified or modified as described for this sequence
ggcccaggaaagaaccuagtt

SEQ ID NO: 1676 - DNA, 21 bp, Artificial Sequence
  Description of Artificial Sequence: Target Sequence/siNA sense region (stab07)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(3): 2'-deoxy-2'Fluoro
  misc_feature (4)..(9): 2'-deoxy
  misc_feature (10)..(13): 2'-deoxy-2'Fluoro
  misc_feature (14)..(14): 2'-deoxy
  misc_feature (15)..(15): 2'-deoxy-2'Fluoro
  misc_feature (16)..(18): 2'-deoxy
  misc_feature (19)..(19): 2'-deoxy-2'Fluoro
  misc_feature (1)..(19): ribonucleotide unmodified or modified as described for this sequence
cccgggaggucucguagactt

SEQ ID NO: 1677 - DNA, 21 bp, Artificial Sequence
  Description of Artificial Sequence: Target Sequence/siNA sense region (stab07)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(2): 2'-deoxy-2'Fluoro
  misc_feature (3)..(8): 2'-deoxy
  misc_feature (9)..(12): 2'-deoxy-2'Fluoro
  misc_feature (13)..(13): 2'-deoxy
  misc_feature (14)..(14): 2'-deoxy-2'Fluoro
  misc_feature (15)..(17): 2'-deoxy
  misc_feature (18)..(19): 2'-deoxy-2'Fluoro
  misc_feature (1)..(19): ribonucleotide unmodified or modified as described for this sequence
ccgggaggucucguagacctt

SEQ ID NO: 1678 - DNA, 21 bp, Artificial Sequence
  Description of Artificial Sequence: Target Sequence/siNA sense region (stab07)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(1): 2'-deoxy-2'Fluoro
  misc_feature (2)..(7): 2'-deoxy
  misc_feature (8)..(11): 2'-deoxy-2'Fluoro
  misc_feature (12)..(12): 2'-deoxy
  misc_feature (13)..(13): 2'-deoxy-2'Fluoro
  misc_feature (14)..(16): 2'-deoxy
  misc_feature (17)..(18): 2'-deoxy-2'Fluoro
  misc_feature (19)..(19): 2'-deoxy
  misc_feature (1)..(19): ribonucleotide unmodified or modified as described for this sequence
cgggaggucucguagaccgtt

SEQ ID NO: 1679 - DNA, 21 bp, Artificial Sequence
  Description of Artificial Sequence: Target Sequence/siNA sense region (stab07)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(6): 2'-deoxy
  misc_feature (7)..(10): 2'-deoxy-2'Fluoro
  misc_feature (11)..(11): 2'-deoxy
  misc_feature (12)..(12): 2'-deoxy-2'Fluoro
  misc_feature (13)..(15): 2'-deoxy
  misc_feature (16)..(17): 2'-deoxy-2'Fluoro
  misc_feature (18)..(18): 2'-deoxy
  misc_feature (19)..(19): 2'-deoxy-2'Fluoro
  misc_feature (1)..(19): ribonucleotide unmodified or modified as described for this sequence
gggaggucucguagaccgutt

SEQ ID NO: 1680 - DNA, 21 bp, Artificial Sequence
  Description of Artificial Sequence: Target Sequence/siNA antisense region (stab08)
  misc_feature (20)..(20): Phosphorothioate or Phosphorodithioate 3'-Internucleotide Linkage (optionally present)
  misc_feature (2)..(4): 2'-deoxy-2'Fluoro
  misc_feature (5)..(5): 2'-O-methyl
  misc_feature (6)..(6): 2'-deoxy-2'Fluoro
  misc_feature (7)..(10): 2'-O-methyl
  misc_feature (11)..(16): 2'-deoxy-2'Fluoro
  misc_feature (17)..(19): 2'-O-methyl
  misc_feature (1)..(19): ribonucleotide unmodified or modified as described for this sequence
gucuacgagaccucccgggtt

SEQ ID NO: 1681 - DNA, 21 bp, Artificial Sequence
  Description of Artificial Sequence: Target Sequence/siNA antisense region (stab08)
  misc_feature (20)..(20): Phosphorothioate or Phosphorodithioate 3'-Internucleotide Linkage (optionally present)
  misc_feature (3)..(5): 2'-deoxy-2'Fluoro
  misc_feature (6)..(6): 2'-O-methyl
  misc_feature (7)..(7): 2'-deoxy-2'Fluoro
  misc_feature (8)..(11): 2'-O-methyl
  misc_feature (12)..(17): 2'-deoxy-2'Fluoro
  misc_feature (18)..(19): 2'-O-methyl
  misc_feature (1)..(19): ribonucleotide unmodified or modified as described for this sequence
ggucuacgagaccucccggtt

SEQ ID NO: 1682 - DNA, 21 bp, Artificial Sequence
  Description of Artificial Sequence: Target Sequence/siNA antisense region (stab08)
  misc_feature (20)..(20): Phosphorothioate or Phosphorodithioate 3'-Internucleotide Linkage (optionally present)
  misc_feature (1)..(1): 2'-deoxy-2'Fluoro
  misc_feature (2)..(3): 2'-O-methyl
  misc_feature (4)..(6): 2'-deoxy-2'Fluoro
  misc_feature (7)..(7): 2'-O-methyl
  misc_feature (8)..(8): 2'-deoxy-2'Fluoro
  misc_feature (9)..(12): 2'-O-methyl
  misc_feature (13)..(18): 2'-deoxy-2'Fluoro
  misc_feature (19)..(19): 2'-O-methyl
  misc_feature (1)..(19): ribonucleotide unmodified or modified as described for this sequence
cggucuacgagaccucccgtt

SEQ ID NO: 1683 - DNA, 21 bp, Artificial Sequence
  Description of Artificial Sequence: Target Sequence/siNA antisense region (stab08)
  misc_feature (20)..(20): Phosphorothioate or Phosphorodithioate 3'-Internucleotide Linkage (optionally present)
  misc_feature (2)..(2): 2'-deoxy-2'Fluoro
  misc_feature (3)..(4): 2'-O-methyl
  misc_feature (5)..(7): 2'-deoxy-2'Fluoro
  misc_feature (8)..(8): 2'-O-methyl
  misc_feature (9)..(9): 2'-deoxy-2'Fluoro
  misc_feature (10)..(13): 2'-O-methyl
  misc_feature (14)..(19): 2'-deoxy-2'Fluoro
  misc_feature (1)..(19): ribonucleotide unmodified or modified as described for this sequence
acggucuacgagaccuccctt

SEQ ID NO: 1684 - DNA, 21 bp, Artificial Sequence
  Description of Artificial Sequence: Target Sequence/siNA sense region (stab07)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(1): 2'-deoxy-2'Fluoro
  misc_feature (2)..(4): 2'-deoxy
  misc_feature (5)..(5): 2'-deoxy-2'Fluoro
  misc_feature (6)..(6): 2'-deoxy
  misc_feature (7)..(10): 2'-deoxy-2'Fluoro
  misc_feature (11)..(16): 2'-deoxy
  misc_feature (17)..(19): 2'-deoxy-2'Fluoro
  misc_feature (1)..(19): ribonucleotide unmodified or modified as described for this sequence
cagaugcucuggagggccctt

SEQ ID NO: 1685 - DNA, 21 bp, Artificial Sequence
  Description of Artificial Sequence: Target Sequence/siNA sense region (stab07)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(2): 2'-deoxy-2'Fluoro
  misc_feature (3)..(5): 2'-deoxy
  misc_feature (6)..(6): 2'-deoxy-2'Fluoro
  misc_feature (7)..(7): 2'-deoxy
  misc_feature (8)..(11): 2'-deoxy-2'Fluoro
  misc_feature (12)..(17): 2'-deoxy
  misc_feature (18)..(19): 2'-deoxy-2'Fluoro
  misc_feature (1)..(19): ribonucleotide unmodified or modified as described for this sequence
ccagaugcucuggagggcctt

SEQ ID NO: 1686 - DNA, 21 bp, Artificial Sequence
  Description of Artificial Sequence: Target Sequence/siNA sense region (stab07)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(1): 2'-deoxy
  misc_feature (2)..(3): 2'-deoxy-2'Fluoro
  misc_feature (4)..(6): 2'-deoxy
  misc_feature (7)..(7): 2'-deoxy-2'Fluoro
  misc_feature (8)..(8): 2'-deoxy
  misc_feature (9)..(12): 2'-deoxy-2'Fluoro
  misc_feature (13)..(18): 2'-deoxy
  misc_feature (19)..(19): 2'-deoxy-2'Fluoro
  misc_feature (1)..(19): ribonucleotide unmodified or modified as described for this sequence
gccagaugcucuggagggctt

SEQ ID NO: 1687 - DNA, 21 bp, Artificial Sequence
  Description of Artificial Sequence: Target Sequence/siNA sense region (stab07)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(1): 2'-deoxy-2'Fluoro
  misc_feature (2)..(2): 2'-deoxy
  misc_feature (3)..(4): 2'-deoxy-2'Fluoro
  misc_feature (5)..(7): 2'-deoxy
  misc_feature (8)..(8): 2'-deoxy-2'Fluoro
  misc_feature (9)..(9): 2'-deoxy
  misc_feature (10)..(13): 2'-deoxy-2'Fluoro
  misc_feature (14)..(19): 2'-deoxy
  misc_feature (1)..(19): ribonucleotide unmodified or modified as described for this sequence
ugccagaugcucuggagggtt

SEQ ID NO: 1688 - DNA, 21 bp, Artificial Sequence
  Description of Artificial Sequence: Target Sequence/siNA antisense region (stab08)
  misc_feature (20)..(20): Phosphorothioate or Phosphorodithioate 3'-Internucleotide Linkage (optionally present)
  misc_feature (4)..(9): 2'-deoxy-2'Fluoro
  misc_feature (10)..(13): 2'-O-methyl
  misc_feature (14)..(14): 2'-deoxy-2'Fluoro
  misc_feature (15)..(15): 2'-O-methyl
  misc_feature (16)..(18): 2'-deoxy-2'Fluoro
  misc_feature (19)..(19): 2'-O-methyl
  misc_feature (1)..(19): ribonucleotide unmodified or modified as described for this sequence
gggcccuccagagcaucugtt

SEQ ID NO: 1689 - DNA, 21 bp, Artificial Sequence
  Description of Artificial Sequence: Target Sequence/siNA antisense region (stab08)
  misc_feature (20)..(20): Phosphorothioate or Phosphorodithioate 3'-Internucleotide Linkage (optionally present)
  misc_feature (3)..(8): 2'-deoxy-2'Fluoro
  misc_feature (9)..(12): 2'-O-methyl
  misc_feature (13)..(13): 2'-deoxy-2'Fluoro
  misc_feature (14)..(14): 2'-O-methyl
  misc_feature (15)..(17): 2'-deoxy-2'Fluoro
  misc_feature (18)..(19): 2'-O-methyl
  misc_feature (1)..(19): ribonucleotide unmodified or modified as described for this sequence
ggcccuccagagcaucuggtt

SEQ ID NO: 1690 - DNA, 21 bp, Artificial Sequence
  Description of Artificial Sequence: Target Sequence/siNA antisense region (stab08)
  misc_feature (20)..(20): Phosphorothioate or Phosphorodithioate 3'-Internucleotide Linkage (optionally present)
  misc_feature (2)..(7): 2'-deoxy-2'Fluoro
  misc_feature (8)..(11): 2'-O-methyl
  misc_feature (12)..(12): 2'-deoxy-2'Fluoro
  misc_feature (13)..(13): 2'-O-methyl
  misc_feature (14)..(16): 2'-deoxy-2'Fluoro
  misc_feature (17)..(18): 2'-O-methyl
  misc_feature (19)..(19): 2'-deoxy-2'Fluoro
  misc_feature (1)..(19): ribonucleotide unmodified or modified as described for this sequence
gcccuccagagcaucuggctt

SEQ ID NO: 1691 - DNA, 21 bp, Artificial Sequence
  Description of Artificial Sequence: Target Sequence/siNA antisense region (stab08)
  misc_feature (20)..(20): Phosphorothioate or Phosphorodithioate 3'-Internucleotide Linkage (optionally present)
  misc_feature (1)..(6): 2'-deoxy-2'Fluoro
  misc_feature (7)..(10): 2'-O-methyl
  misc_feature (11)..(11): 2'-deoxy-2'Fluoro
  misc_feature (12)..(12): 2'-O-methyl
  misc_feature (13)..(15): 2'-deoxy-2'Fluoro
  misc_feature (16)..(17): 2'-O-methyl
  misc_feature (18)..(18): 2'-deoxy-2'Fluoro
  misc_feature (19)..(19): 2'-O-methyl
  misc_feature (1)..(19): ribonucleotide unmodified or modified as described for this sequence
cccuccagagcaucuggcatt

SEQ ID NO: 1692 - DNA, 21 bp, Artificial Sequence
  Description of Artificial Sequence: Target Sequence/siNA sense region (stab08)
  misc_feature (20)..(20): Phosphorothioate or Phosphorodithioate 3'-Internucleotide Linkage (optionally present)
  misc_feature (1)..(3): 2'-deoxy-2'Fluoro
  misc_feature (4)..(4): 2'-O-methyl
  misc_feature (5)..(5): 2'-deoxy-2'Fluoro
  misc_feature (6)..(7): 2'-O-methyl
  misc_feature (8)..(8): 2'-deoxy-2'Fluoro
  misc_feature (9)..(9): 2'-O-methyl
  misc_feature (10)..(11): 2'-deoxy-2'Fluoro
  misc_feature (12)..(12): 2'-O-methyl
  misc_feature (13)..(15): 2'-deoxy-2'Fluoro
  misc_feature (16)..(17): 2'-O-methyl
  misc_feature (18)..(18): 2'-deoxy-2'Fluoro
  misc_feature (19)..(19): 2'-O-methyl
  misc_feature (1)..(19): ribonucleotide unmodified or modified as described for this sequence
cuugugguacugccugauatt

SEQ ID NO: 1693 - DNA, 21 bp, Artificial Sequence
  Description of Artificial Sequence: Target Sequence/siNA sense region (stab08)
  misc_feature (20)..(20): Phosphorothioate or Phosphorodithioate 3'-Internucleotide Linkage (optionally present)
  misc_feature (1)..(1): 2'-deoxy-2'Fluoro
  misc_feature (2)..(3): 2'-O-methyl
  misc_feature (4)..(4): 2'-deoxy-2'Fluoro
  misc_feature (5)..(5): 2'-O-methyl
  misc_feature (6)..(7): 2'-deoxy-2'Fluoro
  misc_feature (8)..(8): 2'-O-methyl
  misc_feature (9)..(11): 2'-deoxy-2'Fluoro
  misc_feature (12)..(13): 2'-O-methyl
  misc_feature (14)..(14): 2'-deoxy-2'Fluoro
  misc_feature (15)..(18): 2'-O-methyl
  misc_feature (19)..(19): 2'-deoxy-2'Fluoro
  misc_feature (1)..(19): ribonucleotide unmodified or modified as described for this sequence
ugguacugccugauagggutt

SEQ ID NO: 1694 - DNA, 21 bp, Artificial Sequence
  Description of Artificial Sequence: Target Sequence/siNA sense region (stab08)
  misc_feature (20)..(20): Phosphorothioate or Phosphorodithioate 3'-Internucleotide Linkage (optionally present)
  misc_feature (1)..(4): 2'-deoxy-2'Fluoro
  misc_feature (5)..(10): 2'-O-methyl
  misc_feature (11)..(14): 2'-deoxy-2'Fluoro
  misc_feature (15)..(15): 2'-O-methyl
  misc_feature (16)..(16): 2'-deoxy-2'Fluoro
  misc_feature (17)..(19): 2'-O-methyl
  misc_feature (1)..(19): ribonucleotide unmodified or modified as described for this sequence
ccccgggaggucucguagatt

SEQ ID NO: 1695 - DNA, 21 bp, Artificial Sequence
  Description of Artificial Sequence: Target Sequence/siNA sense region (stab08)
  misc_feature (20)..(20): Phosphorothioate or Phosphorodithioate 3'-Internucleotide Linkage (optionally present)
  misc_feature (2)..(2): 2'-deoxy-2'Fluoro
  misc_feature (3)..(4): 2'-O-methyl
  misc_feature (5)..(7): 2'-deoxy-2'Fluoro
  misc_feature (8)..(8): 2'-O-methyl
  misc_feature (9)..(10): 2'-deoxy-2'Fluoro
  misc_feature (11)..(11): 2'-O-methyl
  misc_feature (12)..(12): 2'-deoxy-2'Fluoro
  misc_feature (13)..(14): 2'-O-methyl
  misc_feature (15)..(15): 2'-deoxy-2'Fluoro
  misc_feature (16)..(16): 2'-O-methyl
  misc_feature (17)..(19): 2'-deoxy-2'Fluoro
  misc_feature (1)..(19): ribonucleotide unmodified or modified as described for this sequence
auaguccgucaugguguuctt

SEQ ID NO: 1696 - DNA, 21 bp, Artificial Sequence
  Description of Artificial Sequence: Target Sequence/siNA sense region (stab08)
  misc_feature (20)..(20): Phosphorothioate or Phosphorodithioate 3'-Internucleotide Linkage (optionally present)
  misc_feature (1)..(1): 2'-deoxy-2'Fluoro
  misc_feature (2)..(5): 2'-O-methyl
  misc_feature (6)..(6): 2'-deoxy-2'Fluoro
  misc_feature (7)..(8): 2'-O-methyl
  misc_feature (9)..(11): 2'-deoxy-2'Fluoro
  misc_feature (12)..(12): 2'-O-methyl
  misc_feature (13)..(14): 2'-deoxy-2'Fluoro
  misc_feature (15)..(15): 2'-O-methyl
  misc_feature (16)..(16): 2'-deoxy-2'Fluoro
  misc_feature (17)..(18): 2'-O-methyl
  misc_feature (19)..(19): 2'-deoxy-2'Fluoro
  misc_feature (1)..(19): ribonucleotide unmodified or modified as described for this sequence
ugggauaguccgucauggutt

SEQ ID NO: 1697 - DNA, 21 bp, Artificial Sequence
  Description of Artificial Sequence: Target Sequence/siNA sense region (stab08)
  misc_feature (20)..(20): Phosphorothioate or Phosphorodithioate 3'-Internucleotide Linkage (optionally present)
  misc_feature (4)..(4): 2'-deoxy-2'Fluoro
  misc_feature (5)..(5): 2'-O-methyl
  misc_feature (6)..(9): 2'-deoxy-2'Fluoro
  misc_feature (10)..(15): 2'-O-methyl
  misc_feature (16)..(19): 2'-deoxy-2'Fluoro
  misc_feature (1)..(19): ribonucleotide unmodified or modified as described for this sequence
agaugcucuggagggcccctt

SEQ ID NO: 1698 - DNA, 21 bp, Artificial Sequence
  Description of Artificial Sequence: Target Sequence/siNA sense region (stab08)
  misc_feature (20)..(20): Phosphorothioate or Phosphorodithioate 3'-Internucleotide Linkage (optionally present)
  misc_feature (1)..(2): 2'-deoxy-2'Fluoro
  misc_feature (3)..(8): 2'-O-methyl
  misc_feature (9)..(12): 2'-deoxy-2'Fluoro
  misc_feature (13)..(13): 2'-O-methyl
  misc_feature (14)..(14): 2'-deoxy-2'Fluoro
  misc_feature (15)..(17): 2'-O-methyl
  misc_feature (18)..(19): 2'-deoxy-2'Fluoro
  misc_feature (1)..(19): ribonucleotide unmodified or modified as described for this sequence
ccgggaggucucguagacctt

SEQ ID NO: 1699 - DNA, 21 bp, Artificial Sequence
  Description of Artificial Sequence: Target Sequence/siNA sense region (stab08)
  misc_feature (20)..(20): Phosphorothioate or Phosphorodithioate 3'-Internucleotide Linkage (optionally present)
  misc_feature (1)..(2): 2'-deoxy-2'Fluoro
  misc_feature (3)..(5): 2'-O-methyl
  misc_feature (6)..(6): 2'-deoxy-2'Fluoro
  misc_feature (7)..(7): 2'-O-methyl
  misc_feature (8)..(11): 2'-deoxy-2'Fluoro
  misc_feature (12)..(17): 2'-O-methyl
  misc_feature (18)..(19): 2'-deoxy-2'Fluoro
  misc_feature (1)..(19): ribonucleotide unmodified or modified as described for this sequence
ccagaugcucuggagggcctt

SEQ ID NO: 1700 - DNA, 21 bp, Artificial Sequence
  Description of Artificial Sequence: Target Sequence/siNA sense region (stab08)
  misc_feature (20)..(20): Phosphorothioate or Phosphorodithioate 3'-Internucleotide Linkage (optionally present)
  misc_feature (1)..(1): 2'-deoxy-2'Fluoro
  misc_feature (2)..(7): 2'-O-methyl
  misc_feature (8)..(11): 2'-deoxy-2'Fluoro
  misc_feature (12)..(12): 2'-O-methyl
  misc_feature (13)..(13): 2'-deoxy-2'Fluoro
  misc_feature (14)..(16): 2'-O-methyl
  misc_feature (17)..(18): 2'-deoxy-2'Fluoro
  misc_feature (19)..(19): 2'-O-methyl
  misc_feature (1)..(19): ribonucleotide unmodified or modified as described for this sequence
cgggaggucucguagaccgtt

SEQ ID NO: 1701 - DNA, 21 bp, Artificial Sequence
  Description of Artificial Sequence: Target Sequence/siNA sense region (stab08)
  misc_feature (20)..(20): Phosphorothioate or Phosphorodithioate 3'-Internucleotide Linkage (optionally present)
  misc_feature (2)..(3): 2'-deoxy-2'Fluoro
  misc_feature (4)..(6): 2'-O-methyl
  misc_feature (7)..(7): 2'-deoxy-2'Fluoro
  misc_feature (8)..(8): 2'-O-methyl
  misc_feature (9)..(12): 2'-deoxy-2'Fluoro
  misc_feature (13)..(18): 2'-O-methyl
  misc_feature (19)..(19): 2'-deoxy-2'Fluoro
  misc_feature (1)..(19): ribonucleotide unmodified or modified as described for this sequence
gccagaugcucuggagggctt

SEQ ID NO: 1702 - DNA, 21 bp, Artificial Sequence
  Description of Artificial Sequence: Target Sequence/siNA sense region (stab08)
  misc_feature (1)..(1): 5'-3 attached terminal deoxyabasic moiety, inverted abasic, inverted nucleotide or other terminal cap that is optionally present
  misc_feature (20)..(20): Phosphorothioate or Phosphorodithioate 3'-Internucleotide Linkage (optionally present)
  misc_feature (1)..(2): 2'-deoxy-2'Fluoro
  misc_feature (3)..(8): 2'-O-methyl
  misc_feature (9)..(12): 2'-deoxy-2'Fluoro
  misc_feature (13)..(13): 2'-O-methyl
  misc_feature (14)..(14): 2'-deoxy-2'Fluoro
  misc_feature (15)..(17): 2'-O-methyl
  misc_feature (18)..(19): 2'-deoxy-2'Fluoro
  misc_feature (1)..(19): ribonucleotide unmodified or modified as described for this sequence
ccgggaggucucguagacctt

SEQ ID NO: 1703 - DNA, 21 bp, Artificial Sequence
  Description of Artificial Sequence: Target Sequence/siNA sense region (stab08)
  misc_feature (21)..(21): 3'-3 attached terminal deoxyabasic moiety, inverted abasic, inverted nucleotide or other terminal cap that is optionally present
  misc_feature (20)..(20): Phosphorothioate or Phosphorodithioate 3'-Internucleotide Linkage (optionally present)
  misc_feature (1)..(2): 2'-deoxy-2'Fluoro
  misc_feature (3)..(8): 2'-O-methyl
  misc_feature (9)..(12): 2'-deoxy-2'Fluoro
  misc_feature (13)..(13): 2'-O-methyl
  misc_feature (14)..(14): 2'-deoxy-2'Fluoro
  misc_feature (15)..(17): 2'-O-methyl
  misc_feature (18)..(19): 2'-deoxy-2'Fluoro
  misc_feature (1)..(19): ribonucleotide unmodified or modified as described for this sequence
ccgggaggucucguagacctt

SEQ ID NO: 1704 - DNA, 21 bp, Artificial Sequence
  Description of Artificial Sequence: Target Sequence/siNA sense region (stab08)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (20)..(20): Phosphorothioate or Phosphorodithioate 3'-Internucleotide Linkage (optionally present)
  misc_feature (1)..(2): 2'-deoxy-2'Fluoro
  misc_feature (3)..(8): 2'-O-methyl
  misc_feature (9)..(12): 2'-deoxy-2'Fluoro
  misc_feature (13)..(13): 2'-O-methyl
  misc_feature (14)..(14): 2'-deoxy-2'Fluoro
  misc_feature (15)..(17): 2'-O-methyl
  misc_feature (18)..(19): 2'-deoxy-2'Fluoro
  misc_feature (1)..(19): ribonucleotide unmodified or modified as described for this sequence
ccgggaggucucguagacctt

SEQ ID NO: 1705 - DNA, 34 bp, Artificial Sequence
  Description of Artificial Sequence: Target Sequence/siNA STRAND region
  misc_feature (1)..(32): ribonucleotide unmodified or modified as described for this sequence
ucucguagaccuuggucuacgagaccucccggtt

SEQ ID NO: 1706 - DNA, 32 bp, Artificial Sequence
  Description of Artificial Sequence: Target Sequence/siNA STRAND region
  misc_feature (1)..(30): ribonucleotide unmodified or modified as described for this sequence
ucguagaccuuggucuacgagaccucccggtt

SEQ ID NO: 1707 - DNA, 30 bp, Artificial Sequence
  Description of Artificial Sequence: Target Sequence/siNA STRAND region
  misc_feature (1)..(28): ribonucleotide unmodified or modified as described for this sequence
guagaccuuggucuacgagaccucccggtt

SEQ ID NO: 1708 - DNA, 28 bp, Artificial Sequence
  Description of Artificial Sequence: Target Sequence/siNA STRAND region
  misc_feature (1)..(26): ribonucleotide unmodified or modified as described for this sequence
agaccuuggucuacgagaccucccggtt

SEQ ID NO: 1709 - RNA, 32 nt, Artificial Sequence
  Description of Artificial Sequence: Target Sequence/siNA STRAND region
ggucuacgagaccucccgguuccgggaggucu

SEQ ID NO: 1710 - RNA, 30 nt, Artificial Sequence
  Description of Artificial Sequence: Target Sequence/siNA STRAND region
ggucuacgagaccucccgguuccgggaggu

SEQ ID NO: 1711 - RNA, 28 nt, Artificial Sequence
  Description of Artificial Sequence: Target Sequence/siNA STRAND region
ggucuacgagaccucccgguuccgggag

SEQ ID NO: 1712 - RNA, 26 nt, Artificial Sequence
  Description of Artificial Sequence: Target Sequence/siNA STRAND region
ggucuacgagaccucccgguuccggg

SEQ ID NO: 1713 - DNA, 35 bp, Artificial Sequence
  Description of Artificial Sequence: Target Sequence/siNA STRAND region
  misc_feature (1)..(33): ribonucleotide unmodified or modified as described for this sequence
cucguagaccgaaaggucuacgagaccucccggtt

SEQ ID NO: 1714 - DNA, 33 bp, Artificial Sequence
  Description of Artificial Sequence: Target Sequence/siNA STRAND region
  misc_feature (1)..(31): ribonucleotide unmodified or modified as described for this sequence
cguagaccgaaaggucuacgagaccucccggtt

SEQ ID NO: 1715 - DNA, 31 bp, Artificial Sequence
  Description of Artificial Sequence: Target Sequence/siNA STRAND region
  misc_feature (1)..(29): ribonucleotide unmodified or modified as described for this sequence
uagaccgaaaggucuacgagaccucccggtt

SEQ ID NO: 1716 - DNA, 29 bp, Artificial Sequence
  Description of Artificial Sequence: Target Sequence/siNA STRAND region
  misc_feature (1)..(27): ribonucleotide unmodified or modified as described for this sequence
gaccgaaaggucuacgagaccucccggtt

SEQ ID NO: 1717 - RNA, 35 nt, Artificial Sequence
  Description of Artificial Sequence: Target Sequence/siNA STRAND region
ggucuacgagaccucccgguugaaaccgggagguc

SEQ ID NO: 1718 - RNA, 33 nt, Artificial Sequence
  Description of Artificial Sequence: Target Sequence/siNA STRAND region
ggucuacgagaccucccgguugaaaccgggagg

SEQ ID NO: 1719 - RNA, 31 nt, Artificial Sequence
  Description of Artificial Sequence: Target Sequence/siNA STRAND region
ggucuacgagaccucccgguugaaaccggga

SEQ ID NO: 1720 - RNA, 29 nt, Artificial Sequence
  Description of Artificial Sequence: Target Sequence/siNA STRAND region
ggucuacgagaccucccgguugaaaccgg

SEQ ID NO: 1721 - DNA, 40 bp, Artificial Sequence
  Description of Artificial Sequence: Target Sequence/siNA STRAND region
  misc_feature (1)..(40): ribonucleotide unmodified or modified as described for this sequence
cguagaccuuuuuguguagggucuacgagaccucccggtt

SEQ ID NO: 1722 - DNA, 38 bp, Artificial Sequence
  Description of Artificial Sequence: Target Sequence/siNA STRAND region
  misc_feature (1)..(36): ribonucleotide unmodified or modified as described for this sequence
uagaccuuuuuguguagggucuacgagaccucccggtt

SEQ ID NO: 1723 - DNA, 36 bp, Artificial Sequence
  Description of Artificial Sequence: Target Sequence/siNA STRAND region
  misc_feature (1)..(34): ribonucleotide unmodified or modified as described for this sequence
gaccuuuuuguguagggucuacgagaccucccggtt

SEQ ID NO: 1724 - DNA, 34 bp, Artificial Sequence
  Description of Artificial Sequence: Target Sequence/siNA STRAND region
  misc_feature (1)..(32): ribonucleotide unmodified or modified as described for this sequence
ccuuuuuguguagggucuacgagaccucccggtt

SEQ ID NO: 1725 - RNA, 40 nt, Artificial Sequence
  Description of Artificial Sequence: Target Sequence/siNA STRAND region
ggucuacgagaccucccgguuuuuguguagccgggagguc

SEQ ID NO: 1726 - RNA, 38 nt, Artificial Sequence
  Description of Artificial Sequence: Target Sequence/siNA STRAND region
ggucuacgagaccucccgguuuuuguguagccgggagg

SEQ ID NO: 1727 - RNA, 36 nt, Artificial Sequence
  Description of Artificial Sequence: Target Sequence/siNA STRAND region
ggucuacgagaccucccgguuuuuguguagccggga

SEQ ID NO: 1728 - RNA, 34 nt, Artificial Sequence
  Description of Artificial Sequence: Target Sequence/siNA STRAND region
ggucuacgagaccucccgguuuuuguguagccgg

SEQ ID NO: 1729 - DNA, 21 bp, Artificial Sequence
  Description of Artificial Sequence: Target Sequence/siNA antisense region (stab05)
  misc_feature (20)..(20): Phosphorothioate or Phosphorodithioate 3'-Internucleotide Linkage (optionally present)
  misc_feature (3)..(5): 2'-deoxy-2'Fluoro
  misc_feature (7)..(7): 2'-deoxy-2'Fluoro
  misc_feature (12)..(17): 2'-deoxy-2'Fluoro
  misc_feature (1)..(19): ribonucleotide unmodified or modified as described for this sequence
ggucuacgagaccucccggtt

SEQ ID NO: 1730 - DNA, 21 bp, Artificial Sequence
  Description of Artificial Sequence: Target Sequence/siNA antisense region (stab05)
  misc_feature (20)..(20): Phosphorothioate or Phosphorodithioate 3'-Internucleotide Linkage (optionally present)
  misc_feature (1)..(1): Terminal 5' phosphate
  misc_feature (3)..(5): 2'-deoxy-2'Fluoro
  misc_feature (7)..(7): 2'-deoxy-2'Fluoro
  misc_feature (12)..(17): 2'-deoxy-2'Fluoro
  misc_feature (1)..(19): ribonucleotide unmodified or modified as described for this sequence
ggucuacgagaccucccggtt

SEQ ID NO: 1731 - DNA, 21 bp, Artificial Sequence
  Description of Artificial Sequence: Target Sequence/siNA antisense region (stab05)
  misc_feature (20)..(20): Phosphorothioate or Phosphorodithioate 3'-Internucleotide Linkage (optionally present)
  misc_feature (20)..(20): Phosphorothioate or Phosphorodithioate 3'-Internucleotide Linkage (optionally present)
  misc_feature (3)..(5): 2'-deoxy-2'Fluoro
  misc_feature (7)..(7): 2'-deoxy-2'Fluoro
  misc_feature (12)..(17): 2'-deoxy-2'Fluoro
  misc_feature (1)..(19): ribonucleotide unmodified or modified as described for this sequence
ggucuacgagaccucccggtt

SEQ ID NO: 1732 - DNA, 21 bp, Artificial Sequence
  Description of Artificial Sequence: Target Sequence/siNA antisense region (stab00)
  misc_feature (1)..(19): ribonucleotide unmodified or modified as described for this sequence
ggucuacgagaccucccggtt

SEQ ID NO: 1733 - DNA, 21 bp, Artificial Sequence
  Description of Artificial Sequence: Target Sequence/siNA antisense region
  misc_feature (1)..(1): Terminal 5' phosphate
  misc_feature (1)..(19): ribonucleotide unmodified or modified as described for this sequence
ggucuacgagaccucccggtt

SEQ ID NO: 1734 - DNA, 21 bp, Artificial Sequence
  Description of Artificial Sequence: Target Sequence/siNA antisense region
  misc_feature (1)..(1): Phosphorothioate or Phosphorodithioate 3'-Internucleotide Linkage (optionally present)
  misc_feature (1)..(19): ribonucleotide unmodified or modified as described for this sequence
ggucuacgagaccucccggtt

SEQ ID NO: 1735 - DNA, 23 bp, Artificial Sequence
  Description of Artificial Sequence: Target Sequence/siNA antisense region
  misc_feature (1)..(1): Terminal 5' phosphate
  misc_feature (1)..(21): ribonucleotide unmodified or modified as described for this sequence
ggucuacgagaccucccggggtt

SEQ ID NO: 1736 - RNA, 27 nt, Artificial Sequence
  Description of Artificial Sequence: Target Sequence/siNA antisense region
  misc_feature (27)..(27): 3'-3 attached terminal deoxyabasic moiety, inverted abasic, inverted nucleotide or other terminal cap that is optionally present
  misc_feature (1)..(1): Terminal 5' phosphate
ggucuacgagaccucccggucucguau

SEQ ID NO: 1737 - RNA, 31 nt, Artificial Sequence
  Description of Artificial Sequence: Target Sequence/siNA antisense region
  misc_feature (31)..(31): 3'-3 attached terminal deoxyabasic moiety, inverted abasic, inverted nucleotide or other terminal cap that is optionally present
  misc_feature (1)..(1): Terminal 5' phosphate
ggucuacgagaccucccggaggucucguauu

SEQ ID NO: 1738 - DNA, 29 bp, Artificial Sequence
  Description of Artificial Sequence: Target Sequence/siNA antisense region
  misc_feature (29)..(29): 3'-3 attached terminal deoxyabasic moiety, inverted abasic, inverted nucleotide or other terminal cap that is optionally present
  misc_feature (1)..(1): Terminal 5' phosphate
  misc_feature (1)..(19): ribonucleotide unmodified or modified as described for this sequence
  misc_feature (22)..(29): ribonucleotide unmodified or modified as described for this sequence
ggucuacgagaccucccggttucucguau

SEQ ID NO: 1739 - DNA, 32 bp, Artificial Sequence
  Description of Artificial Sequence: Target Sequence/siNA antisense region
  misc_feature (32)..(32): 3'-3 attached terminal deoxyabasic moiety, inverted abasic, inverted nucleotide or other terminal cap that is optionally present
  misc_feature (1)..(1): Terminal 5' phosphate
  misc_feature (1)..(19): ribonucleotide unmodified or modified as described for this sequence
  misc_feature (22)..(32): ribonucleotide unmodified or modified as described for this sequence
ggucuacgagaccucccggttaggucucguau

SEQ ID NO: 1740 - DNA, 21 bp, Artificial Sequence
  Description of Artificial Sequence: Target Sequence/siNA sense region (stab04)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(2): 2'-deoxy-2'Fluoro
  misc_feature (9)..(12): 2'-deoxy-2'Fluoro
  misc_feature (14)..(14): 2'-deoxy-2'Fluoro
  misc_feature (18)..(19): 2'-deoxy-2'Fluoro
  misc_feature (1)..(19): ribonucleotide unmodified or modified as described for this sequence
ccgggaggucucguagacctt

SEQ ID NO: 1741 - DNA, 21 bp, Artificial Sequence
  Description of Artificial Sequence: Target Sequence/siNA sense region (stab09)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(19): ribonucleotide unmodified or modified as described for this sequence
ccccgggaggucucguagatt

SEQ ID NO: 1742 - DNA, 21 bp, Artificial Sequence
  Description of Artificial Sequence: Target Sequence/siNA sense region (stab09)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(19): ribonucleotide unmodified or modified as described for this sequence
cccgggaggucucguagactt

SEQ ID NO: 1743 - DNA, 21 bp, Artificial Sequence
  Description of Artificial Sequence: Target Sequence/siNA sense region (stab09)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(19): ribonucleotide unmodified or modified as described for this sequence
ccgggaggucucguagacctt

SEQ ID NO: 1744 - DNA, 21 bp, Artificial Sequence
  Description of Artificial Sequence: Target Sequence/siNA sense region (stab09)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(19): ribonucleotide unmodified or modified as described for this sequence
cgggaggucucguagaccgtt

SEQ ID NO: 1745 - DNA, 21 bp, Artificial Sequence
  Description of Artificial Sequence: Target Sequence/siNA sense region (stab09)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(19): ribonucleotide unmodified or modified as described for this sequence
gggaggucucguagaccgutt

SEQ ID NO: 1746 - DNA, 21 bp, Artificial Sequence
  Description of Artificial Sequence: Target Sequence/siNA antisense region (stab10)
  misc_feature (20)..(20): Phosphorothioate or Phosphorodithioate 3'-Internucleotide Linkage (optionally present)
  misc_feature (1)..(19): ribonucleotide unmodified or modified as described for this sequence
ucuacgagaccucccggggtt

SEQ ID NO: 1747 - DNA, 21 bp, Artificial Sequence
  Description of Artificial Sequence: Target Sequence/siNA antisense region (stab10)
  misc_feature (20)..(20): Phosphorothioate or Phosphorodithioate 3'-Internucleotide Linkage (optionally present)
  misc_feature (1)..(19): ribonucleotide unmodified or modified as described for this sequence
gucuacgagaccucccgggtt

SEQ ID NO: 1748 - DNA, 21 bp, Artificial Sequence
  Description of Artificial Sequence: Target Sequence/siNA antisense region (stab10)
  misc_feature (20)..(20): Phosphorothioate or Phosphorodithioate 3'-Internucleotide Linkage (optionally present)
  misc_feature (1)..(19): ribonucleotide unmodified or modified as described for this sequence
ggucuacgagaccucccggtt

SEQ ID NO: 1749 - DNA, 21 bp, Artificial Sequence
  Description of Artificial Sequence: Target Sequence/siNA antisense region (stab10)
  misc_feature (20)..(20): Phosphorothioate or Phosphorodithioate 3'-Internucleotide Linkage (optionally present)
  misc_feature (1)..(19): ribonucleotide unmodified or modified as described for this sequence
cggucuacgagaccucccgtt

SEQ ID NO: 1750 - DNA, 21 bp, Artificial Sequence
  Description of Artificial Sequence: Target Sequence/siNA antisense region (stab10)
  misc_feature (20)..(20): Phosphorothioate or Phosphorodithioate 3'-Internucleotide Linkage (optionally present)
  misc_feature (1)..(19): ribonucleotide unmodified or modified as described for this sequence
acggucuacgagaccuccctt

SEQ ID NO: 1751 - DNA, 21 bp, Artificial Sequence
  Description of Artificial Sequence: Target Sequence/siNA sense region (stab04)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(2): 2'-deoxy-2'Fluoro
  misc_feature (6)..(6): 2'-deoxy-2'Fluoro
  misc_feature (8)..(11): 2'-deoxy-2'Fluoro
  misc_feature (18)..(19): 2'-deoxy-2'Fluoro
  misc_feature (1)..(19): ribonucleotide unmodified or modified as described for this sequence
ccagaugcucuggagggcctt

SEQ ID NO: 1752 - DNA, 21 bp, Artificial Sequence
  Description of Artificial Sequence: Target Sequence/siNA antisense region (stab05)
  misc_feature (20)..(20): Phosphorothioate or Phosphorodithioate 3'-Internucleotide Linkage (optionally present)
  misc_feature (3)..(8): 2'-deoxy-2'Fluoro
  misc_feature (13)..(13): 2'-deoxy-2'Fluoro
  misc_feature (15)..(17): 2'-deoxy-2'Fluoro
  misc_feature (1)..(19): ribonucleotide unmodified or modified as described for this sequence
ggcccuccagagcaucuggtt

SEQ ID NO: 1753 - DNA, 21 bp, Artificial Sequence
  Description of Artificial Sequence: Target Sequence/siNA sense region (stab09)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(19): ribonucleotide unmodified or modified as described for this sequence
agaugcucuggagggcccctt

SEQ ID NO: 1754 - DNA, 21 bp, Artificial Sequence
  Description of Artificial Sequence: Target Sequence/siNA sense region (stab09)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(19): ribonucleotide unmodified or modified as described for this sequence
cagaugcucuggagggccctt

SEQ ID NO: 1755 - DNA, 21 bp, Artificial Sequence
  Description of Artificial Sequence: Target Sequence/siNA sense region (stab09)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(19): ribonucleotide unmodified or modified as described for this sequence
ccagaugcucuggagggcctt

SEQ ID NO: 1756 - DNA, 21 bp, Artificial Sequence
  Description of Artificial Sequence: Target Sequence/siNA sense region (stab09)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(19): ribonucleotide unmodified or modified as described for this sequence
gccagaugcucuggagggctt

SEQ ID NO: 1757 - DNA, 21 bp, Artificial Sequence
  Description of Artificial Sequence: Target Sequence/siNA sense region (stab09)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(19): ribonucleotide unmodified or modified as described for this sequence
ugccagaugcucuggagggtt

SEQ ID NO: 1758 - DNA, 21 bp, Artificial Sequence
  Description of Artificial Sequence: Target Sequence/siNA antisense region (stab10)
  misc_feature (20)..(20): Phosphorothioate or Phosphorodithioate 3'-Internucleotide Linkage (optionally present)
  misc_feature (1)..(19): ribonucleotide unmodified or modified as described for this sequence
ggggcccuccagagcaucutt

SEQ ID NO: 1759 - DNA, 21 bp, Artificial Sequence
  Description of Artificial Sequence: Target Sequence/siNA antisense region (stab10)
  misc_feature (20)..(20): Phosphorothioate or Phosphorodithioate 3'-Internucleotide Linkage (optionally present)
  misc_feature (1)..(19): ribonucleotide unmodified or modified as described for this sequence
gggcccuccagagcaucugtt

SEQ ID NO: 1760 - DNA, 21 bp, Artificial Sequence
  Description of Artificial Sequence: Target Sequence/siNA antisense region (stab10)
  misc_feature (20)..(20): Phosphorothioate or Phosphorodithioate 3'-Internucleotide Linkage (optionally present)
  misc_feature (1)..(19): ribonucleotide unmodified or modified as described for this sequence
ggcccuccagagcaucuggtt

SEQ ID NO: 1761 - DNA, 21 bp, Artificial Sequence
  Description of Artificial Sequence: Target Sequence/siNA antisense region (stab10)
  misc_feature (20)..(20): Phosphorothioate or Phosphorodithioate 3'-Internucleotide Linkage (optionally present)
  misc_feature (1)..(19): ribonucleotide unmodified or modified as described for this sequence
gcccuccagagcaucuggctt

SEQ ID NO: 1762 - DNA, 21 bp, Artificial Sequence
  Description of Artificial Sequence: Target Sequence/siNA antisense region (stab10)
  misc_feature (20)..(20): Phosphorothioate or Phosphorodithioate 3'-Internucleotide Linkage (optionally present)
  misc_feature (1)..(19): ribonucleotide unmodified or modified as described for this sequence
cccuccagagcaucuggcatt

SEQ ID NO: 1763 - RNA, 31 nt, Artificial Sequence
  Description of Artificial Sequence: Target Sequence/siNA antisense region
  misc_feature (31)..(31): 3'-3 attached terminal deoxyabasic moiety, inverted abasic, inverted nucleotide or other terminal cap that is optionally present
  misc_feature (1)..(1): Terminal 5' phosphate
acccuaucaggcaguaccaguacugccugau

SEQ ID NO: 1764 - RNA, 31 nt, Artificial Sequence
  Description of Artificial Sequence: Target Sequence/siNA antisense region
  misc_feature (31)..(31): 3'-3 attached terminal deoxyabasic moiety, inverted abasic, inverted nucleotide or other terminal cap that is optionally present
  misc_feature (1)..(1): Terminal 5' phosphate
acccuaucaggcaguaccgguacugccugau

SEQ ID NO: 1765 - RNA, 31 nt, Artificial Sequence
  Description of Artificial Sequence: Target Sequence/siNA STRAND region
  misc_feature (31)..(31): 3'-3 attached terminal deoxyabasic moiety, inverted abasic, inverted nucleotide or other terminal cap that is optionally present
  misc_feature (1)..(1): Terminal 5' phosphate
ggucuacgagaccucccggaggucucguaga

SEQ ID NO: 1766 - RNA, 28 nt, Artificial Sequence
  Description of Artificial Sequence: Target Sequence/siNA STRAND region
  misc_feature (28)..(28): 3'-3 attached terminal deoxyabasic moiety, inverted abasic, inverted nucleotide or other terminal cap that is optionally present
  misc_feature (1)..(1): Terminal 5' phosphate
ggucuacgagaccuccggaggucucgua

SEQ ID NO: 1767 - DNA, 21 bp, Artificial Sequence
  Description of Artificial Sequence: Target Sequence/siNA antisense region (stab08)
  misc_feature (20)..(20): Phosphorothioate or Phosphorodithioate 3'-Internucleotide Linkage (optionally present)
  misc_feature (1)..(1): 2'-deoxy-2'Fluoro
  misc_feature (2)..(2): 2'-O-methyl
  misc_feature (3)..(4): 2'-deoxy-2'Fluoro
  misc_feature (5)..(5): 2'-O-methyl
  misc_feature (6)..(6): 2'-deoxy-2'Fluoro
  misc_feature (7)..(7): 2'-O-methyl
  misc_feature (8)..(14): 2'-deoxy-2'Fluoro
  misc_feature (15)..(15): 2'-O-methyl
  misc_feature (16)..(17): 2'-deoxy-2'Fluoro
  misc_feature (18)..(18): 2'-O-methyl
  misc_feature (19)..(19): 2'-deoxy-2'Fluoro
  misc_feature (1)..(19): ribonucleotide unmodified or modified as described for this sequence
uaucaggcaguaccacaagtt

SEQ ID NO: 1768 - DNA, 21 bp, Artificial Sequence
  Description of Artificial Sequence: Target Sequence/siNA antisense region (stab08)
  misc_feature (20)..(20): Phosphorothioate or Phosphorodithioate 3'-Internucleotide Linkage (optionally present)
  misc_feature (1)..(15): 2'-deoxy-2'Fluoro
  misc_feature (16)..(16): 2'-O-methyl
  misc_feature (17)..(19): 2'-deoxy-2'Fluoro
  misc_feature (1)..(19): ribonucleotide unmodified or modified as described for this sequence
acccuaucaggcaguaccatt

SEQ ID NO: 1769 - DNA, 21 bp, Artificial Sequence
  Description of Artificial Sequence: Target Sequence/siNA antisense region (stab08)
  misc_feature (20)..(20): Phosphorothioate or Phosphorodithioate 3'-Internucleotide Linkage (optionally present)
  misc_feature (1)..(6): 2'-deoxy-2'Fluoro
  misc_feature (7)..(7): 2'-O-methyl
  misc_feature (8)..(13): 2'-deoxy-2'Fluoro
  misc_feature (14)..(14): 2'-O-methyl
  misc_feature (15)..(19): 2'-deoxy-2'Fluoro
  misc_feature (1)..(19): ribonucleotide unmodified or modified as described for this sequence
ucgcaagcacccuaucaggtt

SEQ ID NO: 1770 - DNA, 21 bp, Artificial Sequence
  Description of Artificial Sequence: Target Sequence/siNA antisense region (stab08)
  misc_feature (20)..(20): Phosphorothioate or Phosphorodithioate 3'-Internucleotide Linkage (optionally present)
  misc_feature (1)..(7): 2'-deoxy-2'Fluoro
  misc_feature (8)..(8): 2'-O-methyl
  misc_feature (9)..(19): 2'-deoxy-2'Fluoro
  misc_feature (1)..(19): ribonucleotide unmodified or modified as described for this sequence
cacucgcaagcacccuauctt

SEQ ID NO: 1771 - DNA, 21 bp, Artificial Sequence
  Description of Artificial Sequence: Target Sequence/siNA antisense region (stab08)
  misc_feature (20)..(20): Phosphorothioate or Phosphorodithioate 3'-Internucleotide Linkage (optionally present)
  misc_feature (1)..(1): 2'-deoxy-2'Fluoro
  misc_feature (2)..(2): 2'-O-methyl
  misc_feature (3)..(7): 2'-deoxy-2'Fluoro
  misc_feature (8)..(8): 2'-O-methyl
  misc_feature (9)..(19): 2'-deoxy-2'Fluoro
  misc_feature (1)..(19): ribonucleotide unmodified or modified as described for this sequence
cacucgcaagcacccuauctt

SEQ ID NO: 1772 - DNA, 21 bp, Artificial Sequence
  Description of Artificial Sequence: Target Sequence/siNA sense region (stab07)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(2): 2'-deoxy-2'Fluoro
  misc_feature (3)..(9): 2'-deoxy
  misc_feature (10)..(11): 2'-deoxy-2'Fluoro
  misc_feature (12)..(12): 2'-deoxy
  misc_feature (13)..(13): 2'-deoxy-2'Fluoro
  misc_feature (14)..(15): 2'-deoxy
  misc_feature (16)..(16): 2'-deoxy-2'Fluoro
  misc_feature (17)..(18): 2'-deoxy
  misc_feature (19)..(19): 2'-deoxy-2'Fluoro
  misc_feature (1)..(19): ribonucleotide unmodified or modified as described for this sequence
ccgggagagccauaguggutt

SEQ ID NO: 1773 - DNA, 21 bp, Artificial Sequence
  Description of Artificial Sequence: Target Sequence/siNA sense region (stab07)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(1): 2'-deoxy-2'Fluoro
  misc_feature (2)..(8): 2'-deoxy
  misc_feature (9)..(10): 2'-deoxy-2'Fluoro
  misc_feature (11)..(11): 2'-deoxy
  misc_feature (12)..(12): 2'-deoxy-2'Fluoro
  misc_feature (13)..(14): 2'-deoxy
  misc_feature (15)..(15): 2'-deoxy-2'Fluoro
  misc_feature (16)..(17): 2'-deoxy
  misc_feature (18)..(19): 2'-deoxy-2'Fluoro
  misc_feature (1)..(19): ribonucleotide unmodified or modified as described for this sequence
cgggagagccauagugguctt

SEQ ID NO: 1774 - DNA, 21 bp, Artificial Sequence
  Description of Artificial Sequence: Target Sequence/siNA sense region (stab07)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(7): 2'-deoxy
  misc_feature (8)..(9): 2'-deoxy-2'Fluoro
  misc_feature (10)..(10): 2'-deoxy
  misc_feature (11)..(11): 2'-deoxy-2'Fluoro
  misc_feature (12)..(13): 2'-deoxy
  misc_feature (14)..(14): 2'-deoxy-2'Fluoro
  misc_feature (15)..(16): 2'-deoxy
  misc_feature (17)..(19): 2'-deoxy-2'Fluoro
  misc_feature (1)..(19): ribonucleotide unmodified or modified as described for this sequence
gggagagccauaguggucutt

SEQ ID NO: 1775 - DNA, 21 bp, Artificial Sequence
  Description of Artificial Sequence: Target Sequence/siNA sense region (stab07)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(1): 2'-deoxy
  misc_feature (2)..(2): 2'-deoxy-2'Fluoro
  misc_feature (3)..(4): 2'-deoxy
  misc_feature (5)..(7): 2'-deoxy-2'Fluoro
  misc_feature (8)..(8): 2'-deoxy
  misc_feature (9)..(9): 2'-deoxy-2'Fluoro
  misc_feature (10)..(13): 2'-deoxy
  misc_feature (14)..(15): 2'-deoxy-2'Fluoro
  misc_feature (16)..(17): 2'-deoxy
  misc_feature (18)..(18): 2'-deoxy-2'Fluoro
  misc_feature (19)..(19): 2'-deoxy
  misc_feature (1)..(19): ribonucleotide unmodified or modified as described for this sequence
guggucugcggaaccggugtt

SEQ ID NO: 1776 - DNA, 21 bp, Artificial Sequence
  Description of Artificial Sequence: Target Sequence/siNA sense region (stab07)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(1): 2'-deoxy-2'Fluoro
  misc_feature (2)..(3): 2'-deoxy
  misc_feature (4)..(6): 2'-deoxy-2'Fluoro
  misc_feature (7)..(7): 2'-deoxy
  misc_feature (8)..(8): 2'-deoxy-2'Fluoro
  misc_feature (9)..(12): 2'-deoxy
  misc_feature (13)..(14): 2'-deoxy-2'Fluoro
  misc_feature (15)..(16): 2'-deoxy
  misc_feature (17)..(17): 2'-deoxy-2'Fluoro
  misc_feature (18)..(19): 2'-deoxy
  misc_feature (1)..(19): ribonucleotide unmodified or modified as described for this sequence
uggucugcggaaccggugatt

SEQ ID NO: 1777 - DNA, 21 bp, Artificial Sequence
  Description of Artificial Sequence: Target Sequence/siNA sense region (stab07)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(2): 2'-deoxy
  misc_feature (3)..(5): 2'-deoxy-2'Fluoro
  misc_feature (6)..(6): 2'-deoxy
  misc_feature (7)..(7): 2'-deoxy-2'Fluoro
  misc_feature (8)..(11): 2'-deoxy
  misc_feature (12)..(13): 2'-deoxy-2'Fluoro
  misc_feature (14)..(15): 2'-deoxy
  misc_feature (16)..(16): 2'-deoxy-2'Fluoro
  misc_feature (17)..(19): 2'-deoxy
  misc_feature (1)..(19): ribonucleotide unmodified or modified as described for this sequence
ggucugcggaaccggugagtt

SEQ ID NO: 1778 - DNA, 21 bp, Artificial Sequence
  Description of Artificial Sequence: Target Sequence/siNA sense region (stab07)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(1): 2'-deoxy
  misc_feature (2)..(4): 2'-deoxy-2'Fluoro
  misc_feature (5)..(5): 2'-deoxy
  misc_feature (6)..(6): 2'-deoxy-2'Fluoro
  misc_feature (7)..(10): 2'-deoxy
  misc_feature (11)..(12): 2'-deoxy-2'Fluoro
  misc_feature (13)..(14): 2'-deoxy
  misc_feature (15)..(15): 2'-deoxy-2'Fluoro
  misc_feature (16)..(18): 2'-deoxy
  misc_feature (19)..(19): 2'-deoxy-2'Fluoro
  misc_feature (1)..(19): ribonucleotide unmodified or modified as described for this sequence
gucugcggaaccggugagutt

SEQ ID NO: 1779 - DNA, 21 bp, Artificial Sequence
  Description of Artificial Sequence: Target Sequence/siNA sense region (stab07)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(3): 2'-deoxy-2'Fluoro
  misc_feature (4)..(4): 2'-deoxy
  misc_feature (5)..(5): 2'-deoxy-2'Fluoro
  misc_feature (6)..(9): 2'-deoxy
  misc_feature (10)..(11): 2'-deoxy-2'Fluoro
  misc_feature (12)..(13): 2'-deoxy
  misc_feature (14)..(14): 2'-deoxy-2'Fluoro
  misc_feature (15)..(17): 2'-deoxy
  misc_feature (18)..(18): 2'-deoxy-2'Fluoro
  misc_feature (19)..(19): 2'-deoxy
  misc_feature (1)..(19): ribonucleotide unmodified or modified as described for this sequence
ucugcggaaccggugaguatt

SEQ ID NO: 1780 - DNA, 21 bp, Artificial Sequence
  Description of Artificial Sequence: Target Sequence/siNA sense region (stab07)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(1): 2'-deoxy-2'Fluoro
  misc_feature (2)..(2): 2'-deoxy
  misc_feature (3)..(3): 2'-deoxy-2'Fluoro
  misc_feature (4)..(7): 2'-deoxy
  misc_feature (8)..(9): 2'-deoxy-2'Fluoro
  misc_feature (10)..(11): 2'-deoxy
  misc_feature (12)..(12): 2'-deoxy-2'Fluoro
  misc_feature (13)..(15): 2'-deoxy
  misc_feature (16)..(16): 2'-deoxy-2'Fluoro
  misc_feature (17)..(17): 2'-deoxy
  misc_feature (18)..(18): 2'-deoxy-2'Fluoro
  misc_feature (19)..(19): 2'-deoxy
  misc_feature (1)..(19): ribonucleotide unmodified or modified as described for this sequence
ugcggaaccggugaguacatt

SEQ ID NO: 1781 - DNA, 21 bp, Artificial Sequence
  Description of Artificial Sequence: Target Sequence/siNA sense region (stab07)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(1): 2'-deoxy
  misc_feature (2)..(2): 2'-deoxy-2'Fluoro
  misc_feature (3)..(6): 2'-deoxy
  misc_feature (7)..(8): 2'-deoxy-2'Fluoro
  misc_feature (9)..(10): 2'-deoxy
  misc_feature (11)..(11): 2'-deoxy-2'Fluoro
  misc_feature (12)..(14): 2'-deoxy
  misc_feature (15)..(15): 2'-deoxy-2'Fluoro
  misc_feature (16)..(16): 2'-deoxy
  misc_feature (17)..(17): 2'-deoxy-2'Fluoro
  misc_feature (18)..(18): 2'-deoxy
  misc_feature (19)..(19): 2'-deoxy-2'Fluoro
  misc_feature (1)..(19): ribonucleotide unmodified or modified as described for this sequence
gcggaaccggugaguacactt

SEQ ID NO: 1782 - DNA, 21 bp, Artificial Sequence
  Description of Artificial Sequence: Target Sequence/siNA sense region (stab07)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(3): 2'-deoxy
  misc_feature (4)..(5): 2'-deoxy-2'Fluoro
  misc_feature (6)..(7): 2'-deoxy
  misc_feature (8)..(8): 2'-deoxy-2'Fluoro
  misc_feature (9)..(11): 2'-deoxy
  misc_feature (12)..(12): 2'-deoxy-2'Fluoro
  misc_feature (13)..(13): 2'-deoxy
  misc_feature (14)..(14): 2'-deoxy-2'Fluoro
  misc_feature (15)..(15): 2'-deoxy
  misc_feature (16)..(17): 2'-deoxy-2'Fluoro
  misc_feature (18)..(19): 2'-deoxy
  misc_feature (1)..(19): ribonucleotide unmodified or modified as described for this sequence
gaaccggugaguacaccggtt

SEQ ID NO: 1783 - DNA, 21 bp, Artificial Sequence
  Description of Artificial Sequence: Target Sequence/siNA sense region (stab07)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(2): 2'-deoxy
  misc_feature (3)..(4): 2'-deoxy-2'Fluoro
  misc_feature (5)..(6): 2'-deoxy
  misc_feature (7)..(7): 2'-deoxy-2'Fluoro
  misc_feature (8)..(10): 2'-deoxy
  misc_feature (11)..(11): 2'-deoxy-2'Fluoro
  misc_feature (12)..(12): 2'-deoxy
  misc_feature (13)..(13): 2'-deoxy-2'Fluoro
  misc_feature (14)..(14): 2'-deoxy
  misc_feature (15)..(16): 2'-deoxy-2'Fluoro
  misc_feature (17)..(19): 2'-deoxy
  misc_feature (1)..(19): ribonucleotide unmodified or modified as described for this sequence
aaccggugaguacaccggatt

SEQ ID NO: 1784 - DNA, 21 bp, Artificial Sequence
  Description of Artificial Sequence: Target Sequence/siNA sense region (stab07)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(1): 2'-deoxy
  misc_feature (2)..(3): 2'-deoxy-2'Fluoro
  misc_feature (4)..(5): 2'-deoxy
  misc_feature (6)..(6): 2'-deoxy-2'Fluoro
  misc_feature (7)..(9): 2'-deoxy
  misc_feature (10)..(10): 2'-deoxy-2'Fluoro
  misc_feature (11)..(11): 2'-deoxy
  misc_feature (12)..(12): 2'-deoxy-2'Fluoro
  misc_feature (13)..(13): 2'-deoxy
  misc_feature (14)..(15): 2'-deoxy-2'Fluoro
  misc_feature (16)..(19): 2'-deoxy
  misc_feature (1)..(19): ribonucleotide unmodified or modified as described for this sequence
accggugaguacaccggaatt

SEQ ID NO: 1785 - DNA, 21 bp, Artificial Sequence
  Description of Artificial Sequence: Target Sequence/siNA sense region (stab07)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(2): 2'-deoxy-2'Fluoro
  misc_feature (3)..(4): 2'-deoxy
  misc_feature (5)..(5): 2'-deoxy-2'Fluoro
  misc_feature (6)..(8): 2'-deoxy
  misc_feature (9)..(9): 2'-deoxy-2'Fluoro
  misc_feature (10)..(10): 2'-deoxy
  misc_feature (11)..(11): 2'-deoxy-2'Fluoro
  misc_feature (12)..(12): 2'-deoxy
  misc_feature (13)..(14): 2'-deoxy-2'Fluoro
  misc_feature (15)..(18): 2'-deoxy
  misc_feature (19)..(19): 2'-deoxy-2'Fluoro
  misc_feature (1)..(19): ribonucleotide unmodified or modified as described for this sequence
ccggugaguacaccggaautt

SEQ ID NO: 1786 - DNA, 21 bp, Artificial Sequence
  Description of Artificial Sequence: Target Sequence/siNA sense region (stab07)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(1): 2'-deoxy
  misc_feature (2)..(2): 2'-deoxy-2'Fluoro
  misc_feature (3)..(8): 2'-deoxy
  misc_feature (9)..(12): 2'-deoxy-2'Fluoro
  misc_feature (13)..(13): 2'-deoxy
  misc_feature (14)..(14): 2'-deoxy-2'Fluoro
  misc_feature (15)..(16): 2'-deoxy
  misc_feature (17)..(17): 2'-deoxy-2'Fluoro
  misc_feature (18)..(18): 2'-deoxy
  misc_feature (19)..(19): 2'-deoxy-2'Fluoro
  misc_feature (1)..(19): ribonucleotide unmodified or modified as described for this sequence
gcgaaaggccuugugguactt

SEQ ID NO: 1787 - DNA, 21 bp, Artificial Sequence
  Description of Artificial Sequence: Target Sequence/siNA sense region (stab07)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(1): 2'-deoxy-2'Fluoro
  misc_feature (2)..(7): 2'-deoxy
  misc_feature (8)..(11): 2'-deoxy-2'Fluoro
  misc_feature (12)..(12): 2'-deoxy
  misc_feature (13)..(13): 2'-deoxy-2'Fluoro
  misc_feature (14)..(15): 2'-deoxy
  misc_feature (16)..(16): 2'-deoxy-2'Fluoro
  misc_feature (17)..(17): 2'-deoxy
  misc_feature (18)..(19): 2'-deoxy-2'Fluoro
  misc_feature (1)..(19): ribonucleotide unmodified or modified as described for this sequence
cgaaaggccuugugguacutt

SEQ ID NO: 1788 - DNA, 21 bp, Artificial Sequence
  Description of Artificial Sequence: Target Sequence/siNA sense region (stab07)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(6): 2'-deoxy
  misc_feature (7)..(10): 2'-deoxy-2'Fluoro
  misc_feature (11)..(11): 2'-deoxy
  misc_feature (12)..(12): 2'-deoxy-2'Fluoro
  misc_feature (13)..(14): 2'-deoxy
  misc_feature (15)..(15): 2'-deoxy-2'Fluoro
  misc_feature (16)..(16): 2'-deoxy
  misc_feature (17)..(18): 2'-deoxy-2'Fluoro
  misc_feature (19)..(19): 2'-deoxy
  misc_feature (1)..(19): ribonucleotide unmodified or modified as described for this sequence
gaaaggccuugugguacugtt

SEQ ID NO: 1789 - DNA, 21 bp, Artificial Sequence
  Description of Artificial Sequence: Target Sequence/siNA sense region (stab07)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(5): 2'-deoxy
  misc_feature (6)..(9): 2'-deoxy-2'Fluoro
  misc_feature (10)..(10): 2'-deoxy
  misc_feature (11)..(11): 2'-deoxy-2'Fluoro
  misc_feature (12)..(13): 2'-deoxy
  misc_feature (14)..(14): 2'-deoxy-2'Fluoro
  misc_feature (15)..(15): 2'-deoxy
  misc_feature (16)..(17): 2'-deoxy-2'Fluoro
  misc_feature (18)..(18): 2'-deoxy
  misc_feature (19)..(19): 2'-deoxy-2'Fluoro
  misc_feature (1)..(19): ribonucleotide unmodified or modified as described for this sequence
aaaggccuugugguacugctt

SEQ ID NO: 1790 - DNA, 21 bp, Artificial Sequence
  Description of Artificial Sequence: Target Sequence/siNA sense region (stab07)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(4): 2'-deoxy
  misc_feature (5)..(8): 2'-deoxy-2'Fluoro
  misc_feature (9)..(9): 2'-deoxy
  misc_feature (10)..(10): 2'-deoxy-2'Fluoro
  misc_feature (11)..(12): 2'-deoxy
  misc_feature (13)..(13): 2'-deoxy-2'Fluoro
  misc_feature (14)..(14): 2'-deoxy
  misc_feature (15)..(16): 2'-deoxy-2'Fluoro
  misc_feature (17)..(17): 2'-deoxy
  misc_feature (18)..(19): 2'-deoxy-2'Fluoro
  misc_feature (1)..(19): ribonucleotide unmodified or modified as described for this sequence
aaggccuugugguacugcctt

SEQ ID NO: 1791 - DNA, 21 bp, Artificial Sequence
  Description of Artificial Sequence: Target Sequence/siNA sense region (stab07)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(2): 2'-deoxy
  misc_feature (3)..(6): 2'-deoxy-2'Fluoro
  misc_feature (7)..(7): 2'-deoxy
  misc_feature (8)..(8): 2'-deoxy-2'Fluoro
  misc_feature (9)..(10): 2'-deoxy
  misc_feature (11)..(11): 2'-deoxy-2'Fluoro
  misc_feature (12)..(12): 2'-deoxy
  misc_feature (13)..(14): 2'-deoxy-2'Fluoro
  misc_feature (15)..(15): 2'-deoxy
  misc_feature (16)..(18): 2'-deoxy-2'Fluoro
  misc_feature (19)..(19): 2'-deoxy
  misc_feature (1)..(19): ribonucleotide unmodified or modified as described for this sequence
ggccuugugguacugccugtt

SEQ ID NO: 1792 - DNA, 21 bp, Artificial Sequence
  Description of Artificial Sequence: Target Sequence/siNA sense region (stab07)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(1): 2'-deoxy
  misc_feature (2)..(5): 2'-deoxy-2'Fluoro
  misc_feature (6)..(6): 2'-deoxy
  misc_feature (7)..(7): 2'-deoxy-2'Fluoro
  misc_feature (8)..(9): 2'-deoxy
  misc_feature (10)..(10): 2'-deoxy-2'Fluoro
  misc_feature (11)..(11): 2'-deoxy
  misc_feature (12)..(13): 2'-deoxy-2'Fluoro
  misc_feature (14)..(14): 2'-deoxy
  misc_feature (15)..(17): 2'-deoxy-2'Fluoro
  misc_feature (18)..(19): 2'-deoxy
  misc_feature (1)..(19): ribonucleotide unmodified or modified as described for this sequence
gccuugugguacugccugatt

SEQ ID NO: 1793 - DNA, 21 bp, Artificial Sequence
  Description of Artificial Sequence: Target Sequence/siNA sense region (stab07)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(4): 2'-deoxy-2'Fluoro
  misc_feature (5)..(5): 2'-deoxy
  misc_feature (6)..(6): 2'-deoxy-2'Fluoro
  misc_feature (7)..(8): 2'-deoxy
  misc_feature (9)..(9): 2'-deoxy-2'Fluoro
  misc_feature (10)..(10): 2'-deoxy
  misc_feature (11)..(12): 2'-deoxy-2'Fluoro
  misc_feature (13)..(13): 2'-deoxy
  misc_feature (14)..(16): 2'-deoxy-2'Fluoro
  misc_feature (17)..(18): 2'-deoxy
  misc_feature (19)..(19): 2'-deoxy-2'Fluoro
  misc_feature (1)..(19): ribonucleotide unmodified or modified as described for this sequence
ccuugugguacugccugautt

SEQ ID NO: 1794 - DNA, 21 bp, Artificial Sequence
  Description of Artificial Sequence: Target Sequence/siNA sense region (stab07)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(1): 2'-deoxy
  misc_feature (2)..(3): 2'-deoxy-2'Fluoro
  misc_feature (4)..(4): 2'-deoxy
  misc_feature (5)..(7): 2'-deoxy-2'Fluoro
  misc_feature (8)..(9): 2'-deoxy
  misc_feature (10)..(10): 2'-deoxy-2'Fluoro
  misc_feature (11)..(14): 2'-deoxy
  misc_feature (15)..(15): 2'-deoxy-2'Fluoro
  misc_feature (16)..(16): 2'-deoxy
  misc_feature (17)..(19): 2'-deoxy-2'Fluoro
  misc_feature (1)..(19): ribonucleotide unmodified or modified as described for this sequence
acugccugauagggugcuutt

SEQ ID NO: 1795 - DNA, 21 bp, Artificial Sequence
  Description of Artificial Sequence: Target Sequence/siNA sense region (stab07)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(1): 2'-deoxy
  misc_feature (2)..(4): 2'-deoxy-2'Fluoro
  misc_feature (5)..(6): 2'-deoxy
  misc_feature (7)..(7): 2'-deoxy-2'Fluoro
  misc_feature (8)..(11): 2'-deoxy
  misc_feature (12)..(12): 2'-deoxy-2'Fluoro
  misc_feature (13)..(13): 2'-deoxy
  misc_feature (14)..(16): 2'-deoxy-2'Fluoro
  misc_feature (17)..(17): 2'-deoxy
  misc_feature (18)..(18): 2'-deoxy-2'Fluoro
  misc_feature (19)..(19): 2'-deoxy
  misc_feature (1)..(19): ribonucleotide unmodified or modified as described for this sequence
gccugauagggugcuugcgtt

SEQ ID NO: 1796 - DNA, 21 bp, Artificial Sequence
  Description of Artificial Sequence: Target Sequence/siNA sense region (stab07)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(2): 2'-deoxy-2'Fluoro
  misc_feature (3)..(4): 2'-deoxy
  misc_feature (5)..(5): 2'-deoxy-2'Fluoro
  misc_feature (6)..(9): 2'-deoxy
  misc_feature (10)..(10): 2'-deoxy-2'Fluoro
  misc_feature (11)..(11): 2'-deoxy
  misc_feature (12)..(14): 2'-deoxy-2'Fluoro
  misc_feature (15)..(15): 2'-deoxy
  misc_feature (16)..(16): 2'-deoxy-2'Fluoro
  misc_feature (17)..(19): 2'-deoxy
  misc_feature (1)..(19): ribonucleotide unmodified or modified as described for this sequence
cugauagggugcuugcgagtt

SEQ ID NO: 1797 - DNA, 21 bp, Artificial Sequence
  Description of Artificial Sequence: Target Sequence/siNA sense region (stab07)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(1): 2'-deoxy-2'Fluoro
  misc_feature (2)..(3): 2'-deoxy
  misc_feature (4)..(4): 2'-deoxy-2'Fluoro
  misc_feature (5)..(8): 2'-deoxy
  misc_feature (9)..(9): 2'-deoxy-2'Fluoro
  misc_feature (10)..(10): 2'-deoxy
  misc_feature (11)..(13): 2'-deoxy-2'Fluoro
  misc_feature (14)..(14): 2'-deoxy
  misc_feature (15)..(15): 2'-deoxy-2'Fluoro
  misc_feature (16)..(18): 2'-deoxy
  misc_feature (19)..(19): 2'-deoxy-2'Fluoro
  misc_feature (1)..(19): ribonucleotide unmodified or modified as described for this sequence
ugauagggugcuugcgagutt

SEQ ID NO: 1798 - DNA, 21 bp, Artificial Sequence
  Description of Artificial Sequence: Target Sequence/siNA sense region (stab07)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(1): 2'-deoxy
  misc_feature (2)..(2): 2'-deoxy-2'Fluoro
  misc_feature (3)..(6): 2'-deoxy
  misc_feature (7)..(7): 2'-deoxy-2'Fluoro
  misc_feature (8)..(8): 2'-deoxy
  misc_feature (9)..(11): 2'-deoxy-2'Fluoro
  misc_feature (12)..(12): 2'-deoxy
  misc_feature (13)..(13): 2'-deoxy-2'Fluoro
  misc_feature (14)..(16): 2'-deoxy
  misc_feature (17)..(17): 2'-deoxy-2'Fluoro
  misc_feature (18)..(18): 2'-deoxy
  misc_feature (19)..(19): 2'-deoxy-2'Fluoro
  misc_feature (1)..(19): ribonucleotide unmodified or modified as described for this sequence
auagggugcuugcgagugctt

SEQ ID NO: 1799 - DNA, 21 bp, Artificial Sequence
  Description of Artificial Sequence: Target Sequence/siNA sense region (stab07)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(1): 2'-deoxy-2'Fluoro
  misc_feature (2)..(5): 2'-deoxy
  misc_feature (6)..(6): 2'-deoxy-2'Fluoro
  misc_feature (7)..(7): 2'-deoxy
  misc_feature (8)..(10): 2'-deoxy-2'Fluoro
  misc_feature (11)..(11): 2'-deoxy
  misc_feature (12)..(12): 2'-deoxy-2'Fluoro
  misc_feature (13)..(15): 2'-deoxy
  misc_feature (16)..(16): 2'-deoxy-2'Fluoro
  misc_feature (17)..(17): 2'-deoxy
  misc_feature (18)..(19): 2'-deoxy-2'Fluoro
  misc_feature (1)..(19): ribonucleotide unmodified or modified as described for this sequence
uagggugcuugcgagugcctt

SEQ ID NO: 1800 - DNA, 21 bp, Artificial Sequence
  Description of Artificial Sequence: Target Sequence/siNA sense region (stab07)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(3): 2'-deoxy
  misc_feature (4)..(4): 2'-deoxy-2'Fluoro
  misc_feature (5)..(5): 2'-deoxy
  misc_feature (6)..(8): 2'-deoxy-2'Fluoro
  misc_feature (9)..(9): 2'-deoxy
  misc_feature (10)..(10): 2'-deoxy-2'Fluoro
  misc_feature (11)..(13): 2'-deoxy
  misc_feature (14)..(14): 2'-deoxy-2'Fluoro
  misc_feature (15)..(15): 2'-deoxy
  misc_feature (16)..(19): 2'-deoxy-2'Fluoro
  misc_feature (1)..(19): ribonucleotide unmodified or modified as described for this sequence
gggugcuugcgagugcccctt

SEQ ID NO: 1801 - DNA, 21 bp, Artificial Sequence
  Description of Artificial Sequence: Target Sequence/siNA sense region (stab07)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(2): 2'-deoxy
  misc_feature (3)..(3): 2'-deoxy-2'Fluoro
  misc_feature (4)..(4): 2'-deoxy
  misc_feature (5)..(7): 2'-deoxy-2'Fluoro
  misc_feature (8)..(8): 2'-deoxy
  misc_feature (9)..(9): 2'-deoxy-2'Fluoro
  misc_feature (10)..(12): 2'-deoxy
  misc_feature (13)..(13): 2'-deoxy-2'Fluoro
  misc_feature (14)..(14): 2'-deoxy
  misc_feature (15)..(18): 2'-deoxy-2'Fluoro
  misc_feature (19)..(19): 2'-deoxy
  misc_feature (1)..(19): ribonucleotide unmodified or modified as described for this sequence
ggugcuugcgagugccccgtt

SEQ ID NO: 1802 - DNA, 21 bp, Artificial Sequence
  Description of Artificial Sequence: Target Sequence/siNA sense region (stab07)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(1): 2'-deoxy
  misc_feature (2)..(4): 2'-deoxy-2'Fluoro
  misc_feature (5)..(5): 2'-deoxy
  misc_feature (6)..(6): 2'-deoxy-2'Fluoro
  misc_feature (7)..(9): 2'-deoxy
  misc_feature (10)..(10): 2'-deoxy-2'Fluoro
  misc_feature (11)..(11): 2'-deoxy
  misc_feature (12)..(15): 2'-deoxy-2'Fluoro
  misc_feature (16)..(19): 2'-deoxy
  misc_feature (1)..(19): ribonucleotide unmodified or modified as described for this sequence
gcuugcgagugccccgggatt

SEQ ID NO: 1803 - DNA, 21 bp, Artificial Sequence
  Description of Artificial Sequence: Target Sequence/siNA sense region (stab07)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(3): 2'-deoxy-2'Fluoro
  misc_feature (4)..(4): 2'-deoxy
  misc_feature (5)..(5): 2'-deoxy-2'Fluoro
  misc_feature (6)..(8): 2'-deoxy
  misc_feature (9)..(9): 2'-deoxy-2'Fluoro
  misc_feature (10)..(10): 2'-deoxy
  misc_feature (11)..(14): 2'-deoxy-2'Fluoro
  misc_feature (15)..(19): 2'-deoxy
  misc_feature (1)..(19): ribonucleotide unmodified or modified as described for this sequence
cuugcgagugccccgggagtt

SEQ ID NO: 1804 - DNA, 21 bp, Artificial Sequence
  Description of Artificial Sequence: Target Sequence/siNA sense region (stab07)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(2): 2'-deoxy-2'Fluoro
  misc_feature (3)..(3): 2'-deoxy
  misc_feature (4)..(4): 2'-deoxy-2'Fluoro
  misc_feature (5)..(7): 2'-deoxy
  misc_feature (8)..(8): 2'-deoxy-2'Fluoro
  misc_feature (9)..(9): 2'-deoxy
  misc_feature (10)..(13): 2'-deoxy-2'Fluoro
  misc_feature (14)..(19): 2'-deoxy
  misc_feature (1)..(19): ribonucleotide unmodified or modified as described for this sequence
uugcgagugccccgggaggtt

SEQ ID NO: 1805 - DNA, 21 bp, Artificial Sequence
  Description of Artificial Sequence: Target Sequence/siNA sense region (stab07)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(1): 2'-deoxy-2'Fluoro
  misc_feature (2)..(2): 2'-deoxy
  misc_feature (3)..(3): 2'-deoxy-2'Fluoro
  misc_feature (4)..(6): 2'-deoxy
  misc_feature (7)..(7): 2'-deoxy-2'Fluoro
  misc_feature (8)..(8): 2'-deoxy
  misc_feature (9)..(12): 2'-deoxy-2'Fluoro
  misc_feature (13)..(18): 2'-deoxy
  misc_feature (19)..(19): 2'-deoxy-2'Fluoro
  misc_feature (1)..(19): ribonucleotide unmodified or modified as described for this sequence
ugcgagugccccgggaggutt

SEQ ID NO: 1806 - DNA, 21 bp, Artificial Sequence
  Description of Artificial Sequence: Target Sequence/siNA sense region (stab07)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(1): 2'-deoxy
  misc_feature (2)..(2): 2'-deoxy-2'Fluoro
  misc_feature (3)..(5): 2'-deoxy
  misc_feature (6)..(6): 2'-deoxy-2'Fluoro
  misc_feature (7)..(7): 2'-deoxy
  misc_feature (8)..(11): 2'-deoxy-2'Fluoro
  misc_feature (12)..(17): 2'-deoxy
  misc_feature (18)..(19): 2'-deoxy-2'Fluoro
  misc_feature (1)..(19): ribonucleotide unmodified or modified as described for this sequence
gcgagugccccgggagguctt

SEQ ID NO: 1807 - DNA, 21 bp, Artificial Sequence
  Description of Artificial Sequence: Target Sequence/siNA sense region (stab07)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(1): 2'-deoxy-2'Fluoro
  misc_feature (2)..(4): 2'-deoxy
  misc_feature (5)..(5): 2'-deoxy-2'Fluoro
  misc_feature (6)..(6): 2'-deoxy
  misc_feature (7)..(10): 2'-deoxy-2'Fluoro
  misc_feature (11)..(16): 2'-deoxy
  misc_feature (17)..(19): 2'-deoxy-2'Fluoro
  misc_feature (1)..(19): ribonucleotide unmodified or modified as described for this sequence
cgagugccccgggaggucutt

SEQ ID NO: 1808 - DNA, 21 bp, Artificial Sequence
  Description of Artificial Sequence: Target Sequence/siNA sense region (stab07)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(3): 2'-deoxy
  misc_feature (4)..(4): 2'-deoxy-2'Fluoro
  misc_feature (5)..(5): 2'-deoxy
  misc_feature (6)..(9): 2'-deoxy-2'Fluoro
  misc_feature (10)..(15): 2'-deoxy
  misc_feature (16)..(19): 2'-deoxy-2'Fluoro
  misc_feature (1)..(19): ribonucleotide unmodified or modified as described for this sequence
gagugccccgggaggucuctt

SEQ ID NO: 1809 - DNA, 21 bp, Artificial Sequence
  Description of Artificial Sequence: Target Sequence/siNA sense region (stab07)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(1): 2'-deoxy
  misc_feature (2)..(2): 2'-deoxy-2'Fluoro
  misc_feature (3)..(3): 2'-deoxy
  misc_feature (4)..(7): 2'-deoxy-2'Fluoro
  misc_feature (8)..(13): 2'-deoxy
  misc_feature (14)..(17): 2'-deoxy-2'Fluoro
  misc_feature (18)..(18): 2'-deoxy
  misc_feature (19)..(19): 2'-deoxy-2'Fluoro
  misc_feature (1)..(19): ribonucleotide unmodified or modified as described for this sequence
gugccccgggaggucucgutt

SEQ ID NO: 1810 - DNA, 21 bp, Artificial Sequence
  Description of Artificial Sequence: Target Sequence/siNA sense region (stab07)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(1): 2'-deoxy-2'Fluoro
  misc_feature (2)..(2): 2'-deoxy
  misc_feature (3)..(6): 2'-deoxy-2'Fluoro
  misc_feature (7)..(12): 2'-deoxy
  misc_feature (13)..(16): 2'-deoxy-2'Fluoro
  misc_feature (17)..(17): 2'-deoxy
  misc_feature (18)..(18): 2'-deoxy-2'Fluoro
  misc_feature (19)..(19): 2'-deoxy
  misc_feature (1)..(19): ribonucleotide unmodified or modified as described for this sequence
ugccccgggaggucucguatt

SEQ ID NO: 1811 - DNA, 21 bp, Artificial Sequence
  Description of Artificial Sequence: Target Sequence/siNA sense region (stab07)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(5): 2'-deoxy
  misc_feature (6)..(9): 2'-deoxy-2'Fluoro
  misc_feature (10)..(10): 2'-deoxy
  misc_feature (11)..(11): 2'-deoxy-2'Fluoro
  misc_feature (12)..(14): 2'-deoxy
  misc_feature (15)..(16): 2'-deoxy-2'Fluoro
  misc_feature (17)..(17): 2'-deoxy
  misc_feature (18)..(18): 2'-deoxy-2'Fluoro
  misc_feature (19)..(19): 2'-deoxy
  misc_feature (1)..(19): ribonucleotide unmodified or modified as described for this sequence
ggaggucucguagaccgugtt

SEQ ID NO: 1812 - DNA, 21 bp, Artificial Sequence
  Description of Artificial Sequence: Target Sequence/siNA antisense region (stab08)
  misc_feature (20)..(20): Phosphorothioate or Phosphorodithioate 3'-Internucleotide Linkage (optionally present)
  misc_feature (2)..(3): 2'-deoxy-2'Fluoro
  misc_feature (4)..(4): 2'-O-methyl
  misc_feature (5)..(6): 2'-deoxy-2'Fluoro
  misc_feature (7)..(7): 2'-O-methyl
  misc_feature (8)..(8): 2'-deoxy-2'Fluoro
  misc_feature (9)..(10): 2'-O-methyl
  misc_feature (11)..(17): 2'-deoxy-2'Fluoro
  misc_feature (18)..(19): 2'-O-methyl
  misc_feature (1)..(19): ribonucleotide unmodified or modified as described for this sequence
accacuauggcucucccggtt

SEQ ID NO: 1813 - DNA, 21 bp, Artificial Sequence
  Description of Artificial Sequence: Target Sequence/siNA antisense region (stab08)
  misc_feature (20)..(20): Phosphorothioate or Phosphorodithioate 3'-Internucleotide Linkage (optionally present)
  misc_feature (2)..(4): 2'-deoxy-2'Fluoro
  misc_feature (5)..(5): 2'-O-methyl
  misc_feature (6)..(7): 2'-deoxy-2'Fluoro
  misc_feature (8)..(8): 2'-O-methyl
  misc_feature (9)..(9): 2'-deoxy-2'Fluoro
  misc_feature (10)..(11): 2'-O-methyl
  misc_feature (12)..(18): 2'-deoxy-2'Fluoro
  misc_feature (19)..(19): 2'-O-methyl
  misc_feature (1)..(19): ribonucleotide unmodified or modified as described for this sequence
gaccacuauggcucucccgtt

SEQ ID NO: 1814 - DNA, 21 bp, Artificial Sequence
  Description of Artificial Sequence: Target Sequence/siNA antisense region (stab08)
  misc_feature (20)..(20): Phosphorothioate or Phosphorodithioate 3'-Internucleotide Linkage (optionally present)
  misc_feature (4)..(5): 2'-deoxy-2'Fluoro
  misc_feature (6)..(6): 2'-O-methyl
  misc_feature (7)..(8): 2'-deoxy-2'Fluoro
  misc_feature (9)..(9): 2'-O-methyl
  misc_feature (10)..(10): 2'-deoxy-2'Fluoro
  misc_feature (11)..(12): 2'-O-methyl
  misc_feature (13)..(19): 2'-deoxy-2'Fluoro
  misc_feature (1)..(19): ribonucleotide unmodified or modified as described for this sequence
agaccacuauggcucuccctt

SEQ ID NO: 1815 - DNA, 21 bp, Artificial Sequence
  Description of Artificial Sequence: Target Sequence/siNA antisense region (stab08)
  misc_feature (20)..(20): Phosphorothioate or Phosphorodithioate 3'-Internucleotide Linkage (optionally present)
  misc_feature (1)..(1): 2'-deoxy-2'Fluoro
  misc_feature (2)..(2): 2'-O-methyl
  misc_feature (3)..(4): 2'-deoxy-2'Fluoro
  misc_feature (5)..(6): 2'-O-methyl
  misc_feature (7)..(10): 2'-deoxy-2'Fluoro
  misc_feature (11)..(11): 2'-O-methyl
  misc_feature (12)..(12): 2'-deoxy-2'Fluoro
  misc_feature (13)..(15): 2'-O-methyl
  misc_feature (16)..(17): 2'-deoxy-2'Fluoro
  misc_feature (18)..(18): 2'-O-methyl
  misc_feature (19)..(19): 2'-deoxy-2'Fluoro
  misc_feature (1)..(19): ribonucleotide unmodified or modified as described for this sequence
caccgguuccgcagaccactt

SEQ ID NO: 1816 - DNA, 21 bp, Artificial Sequence
  Description of Artificial Sequence: Target Sequence/siNA antisense region (stab08)
  misc_feature (20)..(20): Phosphorothioate or Phosphorodithioate 3'-Internucleotide Linkage (optionally present)
  misc_feature (1)..(2): 2'-deoxy-2'Fluoro
  misc_feature (3)..(3): 2'-O-methyl
  misc_feature (4)..(5): 2'-deoxy-2'Fluoro
  misc_feature (6)..(7): 2'-O-methyl
  misc_feature (8)..(11): 2'-deoxy-2'Fluoro
  misc_feature (12)..(12): 2'-O-methyl
  misc_feature (13)..(13): 2'-deoxy-2'Fluoro
  misc_feature (14)..(16): 2'-O-methyl
  misc_feature (17)..(18): 2'-deoxy-2'Fluoro
  misc_feature (19)..(19): 2'-O-methyl
  misc_feature (1)..(19): ribonucleotide unmodified or modified as described for this sequence
ucaccgguuccgcagaccatt

SEQ ID NO: 1817 - DNA, 21 bp, Artificial Sequence
  Description of Artificial Sequence: Target Sequence/siNA antisense region (stab08)
  misc_feature (20)..(20): Phosphorothioate or Phosphorodithioate 3'-Internucleotide Linkage (optionally present)
  misc_feature (1)..(3): 2'-deoxy-2'Fluoro
  misc_feature (4)..(4): 2'-O-methyl
  misc_feature (5)..(6): 2'-deoxy-2'Fluoro
  misc_feature (7)..(8): 2'-O-methyl
  misc_feature (9)..(12): 2'-deoxy-2'Fluoro
  misc_feature (13)..(13): 2'-O-methyl
  misc_feature (14)..(14): 2'-deoxy-2'Fluoro
  misc_feature (15)..(17): 2'-O-methyl
  misc_feature (18)..(19): 2'-deoxy-2'Fluoro
  misc_feature (1)..(19): ribonucleotide unmodified or modified as described for this sequence
cucaccgguuccgcagacctt

SEQ ID NO: 1818 - DNA, 21 bp, Artificial Sequence
  Description of Artificial Sequence: Target Sequence/siNA antisense region (stab08)
  misc_feature (20)..(20): Phosphorothioate or Phosphorodithioate 3'-Internucleotide Linkage (optionally present)
  misc_feature (2)..(4): 2'-deoxy-2'Fluoro
  misc_feature (5)..(5): 2'-O-methyl
  misc_feature (6)..(7): 2'-deoxy-2'Fluoro
  misc_feature (8)..(9): 2'-O-methyl
  misc_feature (10)..(13): 2'-deoxy-2'Fluoro
  misc_feature (14)..(14): 2'-O-methyl
  misc_feature (15)..(15): 2'-deoxy-2'Fluoro
  misc_feature (16)..(18): 2'-O-methyl
  misc_feature (19)..(19): 2'-deoxy-2'Fluoro
  misc_feature (1)..(19): ribonucleotide unmodified or modified as described for this sequence
acucaccgguuccgcagactt

SEQ ID NO: 1819 - DNA, 21 bp, Artificial Sequence
  Description of Artificial Sequence: Target Sequence/siNA antisense region (stab08)
  misc_feature (20)..(20): Phosphorothioate or Phosphorodithioate 3'-Internucleotide Linkage (optionally present)
  misc_feature (1)..(1): 2'-deoxy-2'Fluoro
  misc_feature (2)..(2): 2'-O-methyl
  misc_feature (3)..(5): 2'-deoxy-2'Fluoro
  misc_feature (6)..(6): 2'-O-methyl
  misc_feature (7)..(8): 2'-deoxy-2'Fluoro
  misc_feature (9)..(10): 2'-O-methyl
  misc_feature (11)..(14): 2'-deoxy-2'Fluoro
  misc_feature (15)..(15): 2'-O-methyl
  misc_feature (16)..(16): 2'-deoxy-2'Fluoro
  misc_feature (17)..(19): 2'-O-methyl
  misc_feature (1)..(19): ribonucleotide unmodified or modified as described for this sequence
uacucaccgguuccgcagatt

SEQ ID NO: 1820 - DNA, 21 bp, Artificial Sequence
  Description of Artificial Sequence: Target Sequence/siNA antisense region (stab08)
  misc_feature (20)..(20): Phosphorothioate or Phosphorodithioate 3'-Internucleotide Linkage (optionally present)
  misc_feature (1)..(1): 2'-deoxy-2'Fluoro
  misc_feature (2)..(2): 2'-O-methyl
  misc_feature (3)..(3): 2'-deoxy-2'Fluoro
  misc_feature (4)..(4): 2'-O-methyl
  misc_feature (5)..(7): 2'-deoxy-2'Fluoro
  misc_feature (8)..(8): 2'-O-methyl
  misc_feature (9)..(10): 2'-deoxy-2'Fluoro
  misc_feature (11)..(12): 2'-O-methyl
  misc_feature (13)..(16): 2'-deoxy-2'Fluoro
  misc_feature (17)..(17): 2'-O-methyl
  misc_feature (18)..(18): 2'-deoxy-2'Fluoro
  misc_feature (19)..(19): 2'-O-methyl
  misc_feature (1)..(19): ribonucleotide unmodified or modified as described for this sequence
uguacucaccgguuccgcatt

SEQ ID NO: 1821 - DNA, 21 bp, Artificial Sequence
  Description of Artificial Sequence: Target Sequence/siNA antisense region (stab08)
  misc_feature (20)..(20): Phosphorothioate or Phosphorodithioate 3'-Internucleotide Linkage (optionally present)
  misc_feature (2)..(2): 2'-deoxy-2'Fluoro
  misc_feature (3)..(3): 2'-O-methyl
  misc_feature (4)..(4): 2'-deoxy-2'Fluoro
  misc_feature (5)..(5): 2'-O-methyl
  misc_feature (6)..(8): 2'-deoxy-2'Fluoro
  misc_feature (9)..(9): 2'-O-methyl
  misc_feature (10)..(11): 2'-deoxy-2'Fluoro
  misc_feature (12)..(13): 2'-O-methyl
  misc_feature (14)..(17): 2'-deoxy-2'Fluoro
  misc_feature (18)..(18): 2'-O-methyl
  misc_feature (19)..(19): 2'-deoxy-2'Fluoro
  misc_feature (1)..(19): ribonucleotide unmodified or modified as described for this sequence
guguacucaccgguuccgctt

SEQ ID NO: 1822 - DNA, 21 bp, Artificial Sequence
  Description of Artificial Sequence: Target Sequence/siNA antisense region (stab08)
  misc_feature (20)..(20): Phosphorothioate or Phosphorodithioate 3'-Internucleotide Linkage (optionally present)
  misc_feature (1)..(2): 2'-deoxy-2'Fluoro
  misc_feature (3)..(4): 2'-O-methyl
  misc_feature (5)..(5): 2'-deoxy-2'Fluoro
  misc_feature (6)..(6): 2'-O-methyl
  misc_feature (7)..(7): 2'-deoxy-2'Fluoro
  misc_feature (8)..(8): 2'-O-methyl
  misc_feature (9)..(11): 2'-deoxy-2'Fluoro
  misc_feature (12)..(12): 2'-O-methyl
  misc_feature (13)..(14): 2'-deoxy-2'Fluoro
  misc_feature (15)..(16): 2'-O-methyl
  misc_feature (17)..(19): 2'-deoxy-2'Fluoro
  misc_feature (1)..(19): ribonucleotide unmodified or modified as described for this sequence
ccgguguacucaccgguuctt

SEQ ID NO: 1823 - DNA, 21 bp, Artificial Sequence
  Description of Artificial Sequence: Target Sequence/siNA antisense region (stab08)
  misc_feature (20)..(20): Phosphorothioate or Phosphorodithioate 3'-Internucleotide Linkage (optionally present)
  misc_feature (1)..(3): 2'-deoxy-2'Fluoro
  misc_feature (4)..(5): 2'-O-methyl
  misc_feature (6)..(6): 2'-deoxy-2'Fluoro
  misc_feature (7)..(7): 2'-O-methyl
  misc_feature (8)..(8): 2'-deoxy-2'Fluoro
  misc_feature (9)..(9): 2'-O-methyl
  misc_feature (10)..(12): 2'-deoxy-2'Fluoro
  misc_feature (13)..(13): 2'-O-methyl
  misc_feature (14)..(15): 2'-deoxy-2'Fluoro
  misc_feature (16)..(17): 2'-O-methyl
  misc_feature (18)..(19): 2'-deoxy-2'Fluoro
  misc_feature (1)..(19): ribonucleotide unmodified or modified as described for this sequence
uccgguguacucaccgguutt

SEQ ID NO: 1824 - DNA, 21 bp, Artificial Sequence
  Description of Artificial Sequence: Target Sequence/siNA antisense region (stab08)
  misc_feature (20)..(20): Phosphorothioate or Phosphorodithioate 3'-Internucleotide Linkage (optionally present)
  misc_feature (1)..(4): 2'-deoxy-2'Fluoro
  misc_feature (5)..(6): 2'-O-methyl
  misc_feature (7)..(7): 2'-deoxy-2'Fluoro
  misc_feature (8)..(8): 2'-O-methyl
  misc_feature (9)..(9): 2'-deoxy-2'Fluoro
  misc_feature (10)..(10): 2'-O-methyl
  misc_feature (11)..(13): 2'-deoxy-2'Fluoro
  misc_feature (14)..(14): 2'-O-methyl
  misc_feature (15)..(16): 2'-deoxy-2'Fluoro
  misc_feature (17)..(18): 2'-O-methyl
  misc_feature (19)..(19): 2'-deoxy-2'Fluoro
  misc_feature (1)..(19): ribonucleotide unmodified or modified as described for this sequence
uuccgguguacucaccggutt

SEQ ID NO: 1825 - DNA, 21 bp, Artificial Sequence
  Description of Artificial Sequence: Target Sequence/siNA antisense region (stab08)
  misc_feature (20)..(20): Phosphorothioate or Phosphorodithioate 3'-Internucleotide Linkage (optionally present)
  misc_feature (2)..(5): 2'-deoxy-2'Fluoro
  misc_feature (6)..(7): 2'-O-methyl
  misc_feature (8)..(8): 2'-deoxy-2'Fluoro
  misc_feature (9)..(9): 2'-O-methyl
  misc_feature (10)..(10): 2'-deoxy-2'Fluoro
  misc_feature (11)..(11): 2'-O-methyl
  misc_feature (12)..(14): 2'-deoxy-2'Fluoro
  misc_feature (15)..(15): 2'-O-methyl
  misc_feature (16)..(17): 2'-deoxy-2'Fluoro
  misc_feature (18)..(19): 2'-O-methyl
  misc_feature (1)..(19): ribonucleotide unmodified or modified as described for this sequence
auuccgguguacucaccggtt

SEQ ID NO: 1826 - DNA, 21 bp, Artificial Sequence
  Description of Artificial Sequence: Target Sequence/siNA antisense region (stab08)
  misc_feature (20)..(20): Phosphorothioate or Phosphorodithioate 3'-Internucleotide Linkage (optionally present)
  misc_feature (2)..(2): 2'-deoxy-2'Fluoro
  misc_feature (3)..(3): 2'-O-methyl
  misc_feature (4)..(5): 2'-deoxy-2'Fluoro
  misc_feature (6)..(6): 2'-O-methyl
  misc_feature (7)..(7): 2'-deoxy-2'Fluoro
  misc_feature (8)..(11): 2'-O-methyl
  misc_feature (12)..(17): 2'-deoxy-2'Fluoro
  misc_feature (18)..(18): 2'-O-methyl
  misc_feature (19)..(19): 2'-deoxy-2'Fluoro
  misc_feature (1)..(19): ribonucleotide unmodified or modified as described for this sequence
guaccacaaggccuuucgctt

SEQ ID NO: 1827 - DNA, 21 bp, Artificial Sequence
  Description of Artificial Sequence: Target Sequence/siNA antisense region (stab08)
  misc_feature (20)..(20): Phosphorothioate or Phosphorodithioate 3'-Internucleotide Linkage (optionally present)
  misc_feature (3)..(3): 2'-deoxy-2'Fluoro
  misc_feature (4)..(4): 2'-O-methyl
  misc_feature (5)..(6): 2'-deoxy-2'Fluoro
  misc_feature (7)..(7): 2'-O-methyl
  misc_feature (8)..(8): 2'-deoxy-2'Fluoro
  misc_feature (9)..(12): 2'-O-methyl
  misc_feature (13)..(18): 2'-deoxy-2'Fluoro
  misc_feature (19)..(19): 2'-O-methyl
  misc_feature (1)..(19): ribonucleotide unmodified or modified as described for this sequence
aguaccacaaggccuuucgtt

SEQ ID NO: 1828 - DNA, 21 bp, Artificial Sequence
  Description of Artificial Sequence: Target Sequence/siNA antisense region (stab08)
  misc_feature (20)..(20): Phosphorothioate or Phosphorodithioate 3'-Internucleotide Linkage (optionally present)
  misc_feature (1)..(1): 2'-deoxy-2'Fluoro
  misc_feature (2)..(3): 2'-O-methyl
  misc_feature (4)..(4): 2'-deoxy-2'Fluoro
  misc_feature (5)..(5): 2'-O-methyl
  misc_feature (6)..(7): 2'-deoxy-2'Fluoro
  misc_feature (8)..(8): 2'-O-methyl
  misc_feature (9)..(9): 2'-deoxy-2'Fluoro
  misc_feature (10)..(13): 2'-O-methyl
  misc_feature (14)..(19): 2'-deoxy-2'Fluoro
  misc_feature (1)..(19): ribonucleotide unmodified or modified as described for this sequence
caguaccacaaggccuuuctt

SEQ ID NO: 1829 - DNA, 21 bp, Artificial Sequence
  Description of Artificial Sequence: Target Sequence/siNA antisense region (stab08)
  misc_feature (20)..(20): Phosphorothioate or Phosphorodithioate 3'-Internucleotide Linkage (optionally present)
  misc_feature (2)..(2): 2'-deoxy-2'Fluoro
  misc_feature (3)..(4): 2'-O-methyl
  misc_feature (5)..(5): 2'-deoxy-2'Fluoro
  misc_feature (6)..(6): 2'-O-methyl
  misc_feature (7)..(8): 2'-deoxy-2'Fluoro
  misc_feature (9)..(9): 2'-O-methyl
  misc_feature (10)..(10): 2'-deoxy-2'Fluoro
  misc_feature (11)..(14): 2'-O-methyl
  misc_feature (15)..(19): 2'-deoxy-2'Fluoro
  misc_feature (1)..(19): ribonucleotide unmodified or modified as described for this sequence
gcaguaccacaaggccuuutt

SEQ ID NO: 1830 - DNA, 21 bp, Artificial Sequence
  Description of Artificial Sequence: Target Sequence/siNA antisense region (stab08)
  misc_feature (20)..(20): Phosphorothioate or Phosphorodithioate 3'-Internucleotide Linkage (optionally present)
  misc_feature (3)..(3): 2'-deoxy-2'Fluoro
  misc_feature (4)..(5): 2'-O-methyl
  misc_feature (6)..(6): 2'-deoxy-2'Fluoro
  misc_feature (7)..(7): 2'-O-methyl
  misc_feature (8)..(9): 2'-deoxy-2'Fluoro
  misc_feature (10)..(10): 2'-O-methyl
  misc_feature (11)..(11): 2'-deoxy-2'Fluoro
  misc_feature (12)..(15): 2'-O-methyl
  misc_feature (16)..(19): 2'-deoxy-2'Fluoro
  misc_feature (1)..(19): ribonucleotide unmodified or modified as described for this sequence
ggcaguaccacaaggccuutt

SEQ ID NO: 1831 - DNA, 21 bp, Artificial Sequence
  Description of Artificial Sequence: Target Sequence/siNA antisense region (stab08)
  misc_feature (20)..(20): Phosphorothioate or Phosphorodithioate 3'-Internucleotide Linkage (optionally present)
  misc_feature (1)..(1): 2'-deoxy-2'Fluoro
  misc_feature (2)..(4): 2'-O-methyl
  misc_feature (5)..(5): 2'-deoxy-2'Fluoro
  misc_feature (6)..(7): 2'-O-methyl
  misc_feature (8)..(8): 2'-deoxy-2'Fluoro
  misc_feature (9)..(9): 2'-O-methyl
  misc_feature (10)..(11): 2'-deoxy-2'Fluoro
  misc_feature (12)..(12): 2'-O-methyl
  misc_feature (13)..(13): 2'-deoxy-2'Fluoro
  misc_feature (14)..(17): 2'-O-methyl
  misc_feature (18)..(19): 2'-deoxy-2'Fluoro
  misc_feature (1)..(19): ribonucleotide unmodified or modified as described for this sequence
caggcaguaccacaaggcctt

SEQ ID NO: 1832 - DNA, 21 bp, Artificial Sequence
  Description of Artificial Sequence: Target Sequence/siNA antisense region (stab08)
  misc_feature (20)..(20): Phosphorothioate or Phosphorodithioate 3'-Internucleotide Linkage (optionally present)
  misc_feature (1)..(2): 2'-deoxy-2'Fluoro
  misc_feature (3)..(5): 2'-O-methyl
  misc_feature (6)..(6): 2'-deoxy-2'Fluoro
  misc_feature (7)..(8): 2'-O-methyl
  misc_feature (9)..(9): 2'-deoxy-2'Fluoro
  misc_feature (10)..(10): 2'-O-methyl
  misc_feature (11)..(12): 2'-deoxy-2'Fluoro
  misc_feature (13)..(13): 2'-O-methyl
  misc_feature (14)..(14): 2'-deoxy-2'Fluoro
  misc_feature (15)..(18): 2'-O-methyl
  misc_feature (19)..(19): 2'-deoxy-2'Fluoro
  misc_feature (1)..(19): ribonucleotide unmodified or modified as described for this sequence
ucaggcaguaccacaaggctt

SEQ ID NO: 1833 - DNA, 21 bp, Artificial Sequence
  Description of Artificial Sequence: Target Sequence/siNA antisense region (stab08)
  misc_feature (20)..(20): Phosphorothioate or Phosphorodithioate 3'-Internucleotide Linkage (optionally present)
  misc_feature (2)..(3): 2'-deoxy-2'Fluoro
  misc_feature (4)..(6): 2'-O-methyl
  misc_feature (7)..(7): 2'-deoxy-2'Fluoro
  misc_feature (8)..(9): 2'-O-methyl
  misc_feature (10)..(10): 2'-deoxy-2'Fluoro
  misc_feature (11)..(11): 2'-O-methyl
  misc_feature (12)..(13): 2'-deoxy-2'Fluoro
  misc_feature (14)..(14): 2'-O-methyl
  misc_feature (15)..(15): 2'-deoxy-2'Fluoro
  misc_feature (16)..(19): 2'-O-methyl
  misc_feature (1)..(19): ribonucleotide unmodified or modified as described for this sequence
aucaggcaguaccacaaggtt

SEQ ID NO: 1834 - DNA, 21 bp, Artificial Sequence
  Description of Artificial Sequence: Target Sequence/siNA antisense region (stab08)
  misc_feature (20)..(20): Phosphorothioate or Phosphorodithioate 3'-Internucleotide Linkage (optionally present)
  misc_feature (4)..(4): 2'-deoxy-2'Fluoro
  misc_feature (5)..(5): 2'-O-methyl
  misc_feature (6)..(9): 2'-deoxy-2'Fluoro
  misc_feature (10)..(10): 2'-O-methyl
  misc_feature (11)..(12): 2'-deoxy-2'Fluoro
  misc_feature (13)..(15): 2'-O-methyl
  misc_feature (16)..(16): 2'-deoxy-2'Fluoro
  misc_feature (17)..(18): 2'-O-methyl
  misc_feature (19)..(19): 2'-deoxy-2'Fluoro
  misc_feature (1)..(19): ribonucleotide unmodified or modified as described for this sequence
aagcacccuaucaggcagutt

SEQ ID NO: 1835 - DNA, 21 bp, Artificial Sequence
  Description of Artificial Sequence: Target Sequence/siNA antisense region (stab08)
  misc_feature (20)..(20): Phosphorothioate or Phosphorodithioate 3'-Internucleotide Linkage (optionally present)
  misc_feature (1)..(1): 2'-deoxy-2'Fluoro
  misc_feature (2)..(2): 2'-O-methyl
  misc_feature (3)..(3): 2'-deoxy-2'Fluoro
  misc_feature (4)..(6): 2'-O-methyl
  misc_feature (7)..(7): 2'-deoxy-2'Fluoro
  misc_feature (8)..(8): 2'-O-methyl
  misc_feature (9)..(12): 2'-deoxy-2'Fluoro
  misc_feature (13)..(13): 2'-O-methyl
  misc_feature (14)..(15): 2'-deoxy-2'Fluoro
  misc_feature (16)..(18): 2'-O-methyl
  misc_feature (19)..(19): 2'-deoxy-2'Fluoro
  misc_feature (1)..(19): ribonucleotide unmodified or modified as described for this sequence
cgcaagcacccuaucaggctt

SEQ ID NO: 1836 - DNA, 21 bp, Artificial Sequence
  Description of Artificial Sequence: Target Sequence/siNA antisense region (stab08)
  misc_feature (20)..(20): Phosphorothioate or Phosphorodithioate 3'-Internucleotide Linkage (optionally present)
  misc_feature (1)..(3): 2'-deoxy-2'Fluoro
  misc_feature (4)..(4): 2'-O-methyl
  misc_feature (5)..(5): 2'-deoxy-2'Fluoro
  misc_feature (6)..(8): 2'-O-methyl
  misc_feature (9)..(9): 2'-deoxy-2'Fluoro
  misc_feature (10)..(10): 2'-O-methyl
  misc_feature (11)..(14): 2'-deoxy-2'Fluoro
  misc_feature (15)..(15): 2'-O-methyl
  misc_feature (16)..(17): 2'-deoxy-2'Fluoro
  misc_feature (18)..(19): 2'-O-methyl
  misc_feature (1)..(19): ribonucleotide unmodified or modified as described for this sequence
cucgcaagcacccuaucagtt

SEQ ID NO: 1837 - DNA, 21 bp, Artificial Sequence
  Description of Artificial Sequence: Target Sequence/siNA antisense region (stab08)
  misc_feature (20)..(20): Phosphorothioate or Phosphorodithioate 3'-Internucleotide Linkage (optionally present)
  misc_feature (2)..(4): 2'-deoxy-2'Fluoro
  misc_feature (5)..(5): 2'-O-methyl
  misc_feature (6)..(6): 2'-deoxy-2'Fluoro
  misc_feature (7)..(9): 2'-O-methyl
  misc_feature (10)..(10): 2'-deoxy-2'Fluoro
  misc_feature (11)..(11): 2'-O-methyl
  misc_feature (12)..(15): 2'-deoxy-2'Fluoro
  misc_feature (16)..(16): 2'-O-methyl
  misc_feature (17)..(18): 2'-deoxy-2'Fluoro
  misc_feature (19)..(19): 2'-O-methyl
  misc_feature (1)..(19): ribonucleotide unmodified or modified as described for this sequence
acucgcaagcacccuaucatt

SEQ ID NO: 1838 - DNA, 21 bp, Artificial Sequence
  Description of Artificial Sequence: Target Sequence/siNA antisense region (stab08)
  misc_feature (20)..(20): Phosphorothioate or Phosphorodithioate 3'-Internucleotide Linkage (optionally present)
  misc_feature (2)..(2): 2'-deoxy-2'Fluoro
  misc_feature (3)..(3): 2'-O-methyl
  misc_feature (4)..(6): 2'-deoxy-2'Fluoro
  misc_feature (7)..(7): 2'-O-methyl
  misc_feature (8)..(8): 2'-deoxy-2'Fluoro
  misc_feature (9)..(11): 2'-O-methyl
  misc_feature (12)..(12): 2'-deoxy-2'Fluoro
  misc_feature (13)..(13): 2'-O-methyl
  misc_feature (14)..(17): 2'-deoxy-2'Fluoro
  misc_feature (18)..(18): 2'-O-methyl
  misc_feature (19)..(19): 2'-deoxy-2'Fluoro
  misc_feature (1)..(19): ribonucleotide unmodified or modified as described for this sequence
gcacucgcaagcacccuautt

SEQ ID NO: 1839 - DNA, 21 bp, Artificial Sequence
  Description of Artificial Sequence: Target Sequence/siNA antisense region (stab08)
  misc_feature (20)..(20): Phosphorothioate or Phosphorodithioate 3'-Internucleotide Linkage (optionally present)
  misc_feature (3)..(3): 2'-deoxy-2'Fluoro
  misc_feature (4)..(4): 2'-O-methyl
  misc_feature (5)..(7): 2'-deoxy-2'Fluoro
  misc_feature (8)..(8): 2'-O-methyl
  misc_feature (9)..(9): 2'-deoxy-2'Fluoro
  misc_feature (10)..(12): 2'-O-methyl
  misc_feature (13)..(13): 2'-deoxy-2'Fluoro
  misc_feature (14)..(14): 2'-O-methyl
  misc_feature (15)..(18): 2'-deoxy-2'Fluoro
  misc_feature (19)..(19): 2'-O-methyl
  misc_feature (1)..(19): ribonucleotide unmodified or modified as described for this sequence
ggcacucgcaagcacccuatt

SEQ ID NO: 1840 - DNA, 21 bp, Artificial Sequence
  Description of Artificial Sequence: Target Sequence/siNA antisense region (stab08)
  misc_feature (20)..(20): Phosphorothioate or Phosphorodithioate 3'-Internucleotide Linkage (optionally present)
  misc_feature (5)..(5): 2'-deoxy-2'Fluoro
  misc_feature (6)..(6): 2'-O-methyl
  misc_feature (7)..(9): 2'-deoxy-2'Fluoro
  misc_feature (10)..(10): 2'-O-methyl
  misc_feature (11)..(11): 2'-deoxy-2'Fluoro
  misc_feature (12)..(14): 2'-O-methyl
  misc_feature (15)..(15): 2'-deoxy-2'Fluoro
  misc_feature (16)..(16): 2'-O-methyl
  misc_feature (17)..(19): 2'-deoxy-2'Fluoro
  misc_feature (1)..(19): ribonucleotide unmodified or modified as described for this sequence
ggggcacucgcaagcaccctt

SEQ ID NO: 1841 - DNA, 21 bp, Artificial Sequence
  Description of Artificial Sequence: Target Sequence/siNA antisense region (stab08)
  misc_feature (20)..(20): Phosphorothioate or Phosphorodithioate 3'-Internucleotide Linkage (optionally present)
  misc_feature (1)..(1): 2'-deoxy-2'Fluoro
  misc_feature (2)..(5): 2'-O-methyl
  misc_feature (6)..(6): 2'-deoxy-2'Fluoro
  misc_feature (7)..(7): 2'-O-methyl
  misc_feature (8)..(10): 2'-deoxy-2'Fluoro
  misc_feature (11)..(11): 2'-O-methyl
  misc_feature (12)..(12): 2'-deoxy-2'Fluoro
  misc_feature (13)..(15): 2'-O-methyl
  misc_feature (16)..(16): 2'-deoxy-2'Fluoro
  misc_feature (17)..(17): 2'-O-methyl
  misc_feature (18)..(19): 2'-deoxy-2'Fluoro
  misc_feature (1)..(19): ribonucleotide unmodified or modified as described for this sequence
cggggcacucgcaagcacctt

SEQ ID NO: 1842 - DNA, 21 bp, Artificial Sequence
  Description of Artificial Sequence: Target Sequence/siNA antisense region (stab08)
  misc_feature (20)..(20): Phosphorothioate or Phosphorodithioate 3'-Internucleotide Linkage (optionally present)
  misc_feature (1)..(4): 2'-deoxy-2'Fluoro
  misc_feature (5)..(8): 2'-O-methyl
  misc_feature (9)..(9): 2'-deoxy-2'Fluoro
  misc_feature (10)..(10): 2'-O-methyl
  misc_feature (11)..(13): 2'-deoxy-2'Fluoro
  misc_feature (14)..(14): 2'-O-methyl
  misc_feature (15)..(15): 2'-deoxy-2'Fluoro
  misc_feature (16)..(18): 2'-O-methyl
  misc_feature (19)..(19): 2'-deoxy-2'Fluoro
  misc_feature (1)..(19): ribonucleotide unmodified or modified as described for this sequence
ucccggggcacucgcaagctt

SEQ ID NO: 1843 - DNA, 21 bp, Artificial Sequence
  Description of Artificial Sequence: Target Sequence/siNA antisense region (stab08)
  misc_feature (20)..(20): Phosphorothioate or Phosphorodithioate 3'-Internucleotide Linkage (optionally present)
  misc_feature (1)..(5): 2'-deoxy-2'Fluoro
  misc_feature (6)..(9): 2'-O-methyl
  misc_feature (10)..(10): 2'-deoxy-2'Fluoro
  misc_feature (11)..(11): 2'-O-methyl
  misc_feature (12)..(14): 2'-deoxy-2'Fluoro
  misc_feature (15)..(15): 2'-O-methyl
  misc_feature (16)..(16): 2'-deoxy-2'Fluoro
  misc_feature (17)..(19): 2'-O-methyl
  misc_feature (1)..(19): ribonucleotide unmodified or modified as described for this sequence
cucccggggcacucgcaagtt

SEQ ID NO: 1844 - DNA, 21 bp, Artificial Sequence
  Description of Artificial Sequence: Target Sequence/siNA antisense region (stab08)
  misc_feature (20)..(20): Phosphorothioate or Phosphorodithioate 3'-Internucleotide Linkage (optionally present)
  misc_feature (1)..(6): 2'-deoxy-2'Fluoro
  misc_feature (7)..(10): 2'-O-methyl
  misc_feature (11)..(11): 2'-deoxy-2'Fluoro
  misc_feature (12)..(12): 2'-O-methyl
  misc_feature (13)..(15): 2'-deoxy-2'Fluoro
  misc_feature (16)..(16): 2'-O-methyl
  misc_feature (17)..(17): 2'-deoxy-2'Fluoro
  misc_feature (18)..(19): 2'-O-methyl
  misc_feature (1)..(19): ribonucleotide unmodified or modified as described for this sequence
ccucccggggcacucgcaatt

SEQ ID NO: 1845 - DNA, 21 bp, Artificial Sequence
  Description of Artificial Sequence: Target Sequence/siNA antisense region (stab08)
  misc_feature (20)..(20): Phosphorothioate or Phosphorodithioate 3'-Internucleotide Linkage (optionally present)
  misc_feature (2)..(7): 2'-deoxy-2'Fluoro
  misc_feature (8)..(11): 2'-O-methyl
  misc_feature (12)..(12): 2'-deoxy-2'Fluoro
  misc_feature (13)..(13): 2'-O-methyl
  misc_feature (14)..(16): 2'-deoxy-2'Fluoro
  misc_feature (17)..(17): 2'-O-methyl
  misc_feature (18)..(18): 2'-deoxy-2'Fluoro
  misc_feature (19)..(19): 2'-O-methyl
  misc_feature (1)..(19): ribonucleotide unmodified or modified as described for this sequence
accucccggggcacucgcatt

SEQ ID NO: 1846 - DNA, 21 bp, Artificial Sequence
  Description of Artificial Sequence: Target Sequence/siNA antisense region (stab08)
  misc_feature (20)..(20): Phosphorothioate or Phosphorodithioate 3'-Internucleotide Linkage (optionally present)
  misc_feature (3)..(8): 2'-deoxy-2'Fluoro
  misc_feature (9)..(12): 2'-O-methyl
  misc_feature (13)..(13): 2'-deoxy-2'Fluoro
  misc_feature (14)..(14): 2'-O-methyl
  misc_feature (15)..(17): 2'-deoxy-2'Fluoro
  misc_feature (18)..(18): 2'-O-methyl
  misc_feature (19)..(19): 2'-deoxy-2'Fluoro
  misc_feature (1)..(19): ribonucleotide unmodified or modified as described for this sequence
gaccucccggggcacucgctt

SEQ ID NO: 1847 - DNA, 21 bp, Artificial Sequence
  Description of Artificial Sequence: Target Sequence/siNA antisense region (stab08)
  misc_feature (20)..(20): Phosphorothioate or Phosphorodithioate 3'-Internucleotide Linkage (optionally present)
  misc_feature (4)..(9): 2'-deoxy-2'Fluoro
  misc_feature (10)..(13): 2'-O-methyl
  misc_feature (14)..(14): 2'-deoxy-2'Fluoro
  misc_feature (15)..(15): 2'-O-methyl
  misc_feature (16)..(18): 2'-deoxy-2'Fluoro
  misc_feature (19)..(19): 2'-O-methyl
  misc_feature (1)..(19): ribonucleotide unmodified or modified as described for this sequence
agaccucccggggcacucgtt

SEQ ID NO: 1848 - DNA, 21 bp, Artificial Sequence
  Description of Artificial Sequence: Target Sequence/siNA antisense region (stab08)
  misc_feature (20)..(20): Phosphorothioate or Phosphorodithioate 3'-Internucleotide Linkage (optionally present)
  misc_feature (5)..(10): 2'-deoxy-2'Fluoro
  misc_feature (11)..(14): 2'-O-methyl
  misc_feature (15)..(15): 2'-deoxy-2'Fluoro
  misc_feature (16)..(16): 2'-O-methyl
  misc_feature (17)..(19): 2'-deoxy-2'Fluoro
  misc_feature (1)..(19): ribonucleotide unmodified or modified as described for this sequence
gagaccucccggggcacuctt

SEQ ID NO: 1849 - DNA, 21 bp, Artificial Sequence
  Description of Artificial Sequence: Target Sequence/siNA antisense region (stab08)
  misc_feature (20)..(20): Phosphorothioate or Phosphorodithioate 3'-Internucleotide Linkage (optionally present)
  misc_feature (2)..(2): 2'-deoxy-2'Fluoro
  misc_feature (3)..(6): 2'-O-methyl
  misc_feature (7)..(12): 2'-deoxy-2'Fluoro
  misc_feature (13)..(16): 2'-O-methyl
  misc_feature (17)..(17): 2'-deoxy-2'Fluoro
  misc_feature (18)..(18): 2'-O-methyl
  misc_feature (19)..(19): 2'-deoxy-2'Fluoro
  misc_feature (1)..(19): ribonucleotide unmodified or modified as described for this sequence
acgagaccucccggggcactt

SEQ ID NO: 1850 - DNA, 21 bp, Artificial Sequence
  Description of Artificial Sequence: Target Sequence/siNA antisense region (stab08)
  misc_feature (20)..(20): Phosphorothioate or Phosphorodithioate 3'-Internucleotide Linkage (optionally present)
  misc_feature (1)..(1): 2'-deoxy-2'Fluoro
  misc_feature (2)..(2): 2'-O-methyl
  misc_feature (3)..(3): 2'-deoxy-2'Fluoro
  misc_feature (4)..(7): 2'-O-methyl
  misc_feature (8)..(13): 2'-deoxy-2'Fluoro
  misc_feature (14)..(17): 2'-O-methyl
  misc_feature (18)..(18): 2'-deoxy-2'Fluoro
  misc_feature (19)..(19): 2'-O-methyl
  misc_feature (1)..(19): ribonucleotide unmodified or modified as described for this sequence
uacgagaccucccggggcatt

SEQ ID NO: 1851 - DNA, 21 bp, Artificial Sequence
  Description of Artificial Sequence: Target Sequence/siNA antisense region (stab08)
  misc_feature (20)..(20): Phosphorothioate or Phosphorodithioate 3'-Internucleotide Linkage (optionally present)
  misc_feature (1)..(1): 2'-deoxy-2'Fluoro
  misc_feature (2)..(2): 2'-O-methyl
  misc_feature (3)..(3): 2'-deoxy-2'Fluoro
  misc_feature (4)..(5): 2'-O-methyl
  misc_feature (6)..(8): 2'-deoxy-2'Fluoro
  misc_feature (9)..(9): 2'-O-methyl
  misc_feature (10)..(10): 2'-deoxy-2'Fluoro
  misc_feature (11)..(14): 2'-O-methyl
  misc_feature (15)..(19): 2'-deoxy-2'Fluoro
  misc_feature (1)..(19): ribonucleotide unmodified or modified as described for this sequence
cacggucuacgagaccucctt

SEQ ID NO: 1852 - DNA, 21 bp, Artificial Sequence
  Description of Artificial Sequence: Target Sequence/siNA antisense region (stab08)
  misc_feature (20)..(20): Phosphorothioate or Phosphorodithioate 3'-Internucleotide Linkage (optionally present)
  misc_feature (1)..(1): Terminal 5' phosphate
  misc_feature (1)..(2): 2'-deoxy-2'Fluoro
  misc_feature (3)..(3): 2'-O-methyl
  misc_feature (4)..(4): 2'-deoxy-2'Fluoro
  misc_feature (5)..(7): 2'-O-methyl
  misc_feature (8)..(8): 2'-deoxy-2'Fluoro
  misc_feature (9)..(9): 2'-O-methyl
  misc_feature (10)..(13): 2'-deoxy-2'Fluoro
  misc_feature (14)..(14): 2'-O-methyl
  misc_feature (15)..(16): 2'-deoxy-2'Fluoro
  misc_feature (17)..(19): 2'-O-methyl
  misc_feature (1)..(19): ribonucleotide unmodified or modified as described for this sequence
ucgcaagcacccuaucaggtt

SEQ ID NO: 1853 - DNA, 21 bp, Artificial Sequence
  Description of Artificial Sequence: Target Sequence/siNA antisense region (stab05)
  misc_feature (20)..(20): Phosphorothioate or Phosphorodithioate 3'-Internucleotide Linkage (optionally present)
  misc_feature (1)..(1): Terminal 5' phosphate
  misc_feature (1)..(2): 2'-deoxy-2'Fluoro
  misc_feature (4)..(4): 2'-deoxy-2'Fluoro
  misc_feature (8)..(8): 2'-deoxy-2'Fluoro
  misc_feature (10)..(13): 2'-deoxy-2'Fluoro
  misc_feature (15)..(16): 2'-deoxy-2'Fluoro
  misc_feature (1)..(19): ribonucleotide unmodified or modified as described for this sequence
ucgcaagcacccuaucaggtt

SEQ ID NO: 1854 - DNA, 21 bp, Artificial Sequence
  Description of Artificial Sequence: Target Sequence/siNA antisense region (stab05)
  misc_feature (20)..(20): Phosphorothioate or Phosphorodithioate 3'-Internucleotide Linkage (optionally present)
  misc_feature (1)..(1): Terminal 5' phosphate
  misc_feature (2)..(5): 2'-deoxy-2'Fluoro
  misc_feature (7)..(8): 2'-deoxy-2'Fluoro
  misc_feature (12)..(12): 2'-deoxy-2'Fluoro
  misc_feature (15)..(15): 2'-deoxy-2'Fluoro
  misc_feature (17)..(18): 2'-deoxy-2'Fluoro
  misc_feature (1)..(19): ribonucleotide unmodified or modified as described for this sequence
acccuaucaggcaguaccatt

SEQ ID NO: 1855 - DNA, 21 bp, Artificial Sequence
  Description of Artificial Sequence: Target Sequence/siNA antisense region (stab08)
  misc_feature (20)..(20): Phosphorothioate or Phosphorodithioate 3'-Internucleotide Linkage (optionally present)
  misc_feature (1)..(1): Terminal 5' phosphate
  misc_feature (1)..(1): 2'-O-methyl
  misc_feature (2)..(5): 2'-deoxy-2'Fluoro
  misc_feature (6)..(6): 2'-O-methyl
  misc_feature (7)..(8): 2'-deoxy-2'Fluoro
  misc_feature (9)..(11): 2'-O-methyl
  misc_feature (12)..(12): 2'-deoxy-2'Fluoro
  misc_feature (13)..(14): 2'-O-methyl
  misc_feature (15)..(15): 2'-deoxy-2'Fluoro
  misc_feature (16)..(16): 2'-O-methyl
  misc_feature (17)..(18): 2'-deoxy-2'Fluoro
  misc_feature (19)..(19): 2'-O-methyl
  misc_feature (1)..(19): ribonucleotide unmodified or modified as described for this sequence
acccuaucaggcaguaccatt

SEQ ID NO: 1856 - DNA, 21 bp, Artificial Sequence
  Description of Artificial Sequence: Target Sequence/siNA antisense region (stab08)
  misc_feature (20)..(20): Phosphorothioate or Phosphorodithioate 3'-Internucleotide Linkage (optionally present)
  misc_feature (1)..(1): Terminal 5' phosphate
  misc_feature (1)..(1): 2'-deoxy-2'Fluoro
  misc_feature (2)..(2): 2'-O-methyl
  misc_feature (3)..(5): 2'-deoxy-2'Fluoro
  misc_feature (6)..(6): 2'-O-methyl
  misc_feature (7)..(7): 2'-deoxy-2'Fluoro
  misc_feature (8)..(10): 2'-O-methyl
  misc_feature (11)..(11): 2'-deoxy-2'Fluoro
  misc_feature (12)..(12): 2'-O-methyl
  misc_feature (13)..(16): 2'-deoxy-2'Fluoro
  misc_feature (17)..(17): 2'-O-methyl
  misc_feature (18)..(19): 2'-deoxy-2'Fluoro
  misc_feature (1)..(19): ribonucleotide unmodified or modified as described for this sequence
cacucgcaagcacccuauctt

SEQ ID NO: 1857 - DNA, 21 bp, Artificial Sequence
  Description of Artificial Sequence: Target Sequence/siNA antisense region (stab08)
  misc_feature (20)..(20): Phosphorothioate or Phosphorodithioate 3'-Internucleotide Linkage (optionally present)
  misc_feature (1)..(1): Terminal 5' phosphate
  misc_feature (1)..(2): 2'-O-methyl
  misc_feature (3)..(5): 2'-deoxy-2'Fluoro
  misc_feature (6)..(6): 2'-O-methyl
  misc_feature (7)..(7): 2'-deoxy-2'Fluoro
  misc_feature (8)..(11): 2'-O-methyl
  misc_feature (12)..(17): 2'-deoxy-2'Fluoro
  misc_feature (18)..(19): 2'-O-methyl
  misc_feature (1)..(19): ribonucleotide unmodified or modified as described for this sequence
ggucuacgagaccucccggtt

SEQ ID NO: 1858 - DNA, 21 bp, Artificial Sequence
  Description of Artificial Sequence: Target Sequence/siNA antisense region (stab08)
  misc_feature (20)..(20): Phosphorothioate or Phosphorodithioate 3'-Internucleotide Linkage (optionally present)
  misc_feature (0)..(0): hexethelyne glycol spacer (language)
  misc_feature (1)..(2): 2'-deoxy-2'Fluoro
  misc_feature (3)..(3): 2'-O-methyl
  misc_feature (4)..(4): 2'-deoxy-2'Fluoro
  misc_feature (5)..(7): 2'-O-methyl
  misc_feature (8)..(8): 2'-deoxy-2'Fluoro
  misc_feature (9)..(9): 2'-O-methyl
  misc_feature (10)..(13): 2'-deoxy-2'Fluoro
  misc_feature (14)..(14): 2'-O-methyl
  misc_feature (15)..(16): 2'-deoxy-2'Fluoro
  misc_feature (17)..(19): 2'-O-methyl
  misc_feature (1)..(19): ribonucleotide unmodified or modified as described for this sequence
ucgcaagcacccuaucaggtt

SEQ ID NO: 1859 - DNA, 21 bp, Artificial Sequence
  Description of Artificial Sequence: Target Sequence/siNA antisense region (stab05)
  misc_feature (20)..(20): Phosphorothioate or Phosphorodithioate 3'-Internucleotide Linkage (optionally present)
  misc_feature (0)..(0): hexethelyne glycol spacer (language)
  misc_feature (1)..(2): 2'-deoxy-2'Fluoro
  misc_feature (4)..(4): 2'-deoxy-2'Fluoro
  misc_feature (8)..(8): 2'-deoxy-2'Fluoro
  misc_feature (10)..(13): 2'-deoxy-2'Fluoro
  misc_feature (15)..(16): 2'-deoxy-2'Fluoro
  misc_feature (1)..(19): ribonucleotide unmodified or modified as described for this sequence
ucgcaagcacccuaucaggtt

SEQ ID NO: 1860 - DNA, 21 bp, Artificial Sequence
  Description of Artificial Sequence: Target Sequence/siNA antisense region (stab05)
  misc_feature (20)..(20): Phosphorothioate or Phosphorodithioate 3'-Internucleotide Linkage (optionally present)
  misc_feature (0)..(0): hexethelyne glycol spacer (language)
  misc_feature (2)..(5): 2'-deoxy-2'Fluoro
  misc_feature (7)..(8): 2'-deoxy-2'Fluoro
  misc_feature (12)..(12): 2'-deoxy-2'Fluoro
  misc_feature (15)..(15): 2'-deoxy-2'Fluoro
  misc_feature (17)..(18): 2'-deoxy-2'Fluoro
  misc_feature (1)..(19): ribonucleotide unmodified or modified as described for this sequence
acccuaucaggcaguaccatt

SEQ ID NO: 1861 - DNA, 21 bp, Artificial Sequence
  Description of Artificial Sequence: Target Sequence/siNA antisense region (stab08)
  misc_feature (20)..(20): Phosphorothioate or Phosphorodithioate 3'-Internucleotide Linkage (optionally present)
  misc_feature (0)..(0): hexethelyne glycol spacer (language)
  misc_feature (1)..(1): 2'-O-methyl
  misc_feature (2)..(5): 2'-deoxy-2'Fluoro
  misc_feature (6)..(6): 2'-O-methyl
  misc_feature (7)..(8): 2'-deoxy-2'Fluoro
  misc_feature (9)..(11): 2'-O-methyl
  misc_feature (12)..(12): 2'-deoxy-2'Fluoro
  misc_feature (13)..(14): 2'-O-methyl
  misc_feature (15)..(15): 2'-deoxy-2'Fluoro
  misc_feature (16)..(16): 2'-O-methyl
  misc_feature (17)..(18): 2'-deoxy-2'Fluoro
  misc_feature (19)..(19): 2'-O-methyl
  misc_feature (1)..(19): ribonucleotide unmodified or modified as described for this sequence
acccuaucaggcaguaccatt

SEQ ID NO: 1862 - DNA, 21 bp, Artificial Sequence
  Description of Artificial Sequence: Target Sequence/siNA antisense region (stab08)
  misc_feature (20)..(20): Phosphorothioate or Phosphorodithioate 3'-Internucleotide Linkage (optionally present)
  misc_feature (0)..(0): hexethelyne glycol spacer (language)
  misc_feature (1)..(1): 2'-deoxy-2'Fluoro
  misc_feature (2)..(2): 2'-O-methyl
  misc_feature (3)..(5): 2'-deoxy-2'Fluoro
  misc_feature (6)..(6): 2'-O-methyl
  misc_feature (7)..(7): 2'-deoxy-2'Fluoro
  misc_feature (8)..(10): 2'-O-methyl
  misc_feature (11)..(11): 2'-deoxy-2'Fluoro
  misc_feature (12)..(12): 2'-O-methyl
  misc_feature (13)..(16): 2'-deoxy-2'Fluoro
  misc_feature (17)..(17): 2'-O-methyl
  misc_feature (18)..(19): 2'-deoxy-2'Fluoro
  misc_feature (1)..(19): ribonucleotide unmodified or modified as described for this sequence
cacucgcaagcacccuauctt

SEQ ID NO: 1863 - DNA, 21 bp, Artificial Sequence
  Description of Artificial Sequence: Target Sequence/siNA antisense region (stab08)
  misc_feature (20)..(20): Phosphorothioate or Phosphorodithioate 3'-Internucleotide Linkage (optionally present)
  misc_feature (0)..(0): hexethelyne glycol spacer (language)
  misc_feature (1)..(2): 2'-O-methyl
  misc_feature (3)..(5): 2'-deoxy-2'Fluoro
  misc_feature (6)..(6): 2'-O-methyl
  misc_feature (7)..(7): 2'-deoxy-2'Fluoro
  misc_feature (8)..(11): 2'-O-methyl
  misc_feature (12)..(17): 2'-deoxy-2'Fluoro
  misc_feature (18)..(19): 2'-O-methyl
  misc_feature (1)..(19): ribonucleotide unmodified or modified as described for this sequence
ggucuacgagaccucccggtt

SEQ ID NO: 1864 - DNA, 21 bp, Artificial Sequence
  Description of Artificial Sequence: Target Sequence/siNA sense region (stab07)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(2): 2'-deoxy-2'Fluoro
  misc_feature (9)..(10): 2'-deoxy-2'Fluoro
  misc_feature (12)..(12): 2'-deoxy-2'Fluoro
  misc_feature (14)..(14): 2'-deoxy-2'Fluoro
  misc_feature (17)..(19): 2'-deoxy-2'Fluoro
  misc_feature (1)..(19): ribonucleotide unmodified or modified as described for this sequence
ccgagaggucgcguagucctt

SEQ ID NO: 1865 - DNA, 21 bp, Artificial Sequence
  Description of Artificial Sequence: Target Sequence/siNA sense region (stab07)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(2): 2'-deoxy-2'Fluoro
  misc_feature (9)..(10): 2'-deoxy-2'Fluoro
  misc_feature (12)..(12): 2'-deoxy-2'Fluoro
  misc_feature (14)..(15): 2'-deoxy-2'Fluoro
  misc_feature (18)..(19): 2'-deoxy-2'Fluoro
  misc_feature (1)..(19): ribonucleotide unmodified or modified as described for this sequence
ccgagaggucgcgucgauctt

SEQ ID NO: 1866 - DNA, 21 bp, Artificial Sequence
  Description of Artificial Sequence: Target Sequence/siNA sense region (stab07)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(2): 2'-deoxy-2'Fluoro
  misc_feature (5)..(5): 2'-deoxy-2'Fluoro
  misc_feature (9)..(12): 2'-deoxy-2'Fluoro
  misc_feature (14)..(14): 2'-deoxy-2'Fluoro
  misc_feature (18)..(18): 2'-deoxy-2'Fluoro
  misc_feature (1)..(19): ribonucleotide unmodified or modified as described for this sequence
ccgguaggucccguggacatt

SEQ ID NO: 1867 - DNA, 21 bp, Artificial Sequence
  Description of Artificial Sequence: Target Sequence/siNA antisense region (stab08)
  misc_feature (20)..(20): Phosphorothioate or Phosphorodithioate 3'-Internucleotide Linkage (optionally present)
  misc_feature (4)..(5): 2'-deoxy-2'Fluoro
  misc_feature (6)..(6): 2'-O-methyl
  misc_feature (7)..(7): 2'-deoxy-2'Fluoro
  misc_feature (8)..(8): 2'-O-methyl
  misc_feature (9)..(9): 2'-deoxy-2'Fluoro
  misc_feature (10)..(11): 2'-O-methyl
  misc_feature (12)..(17): 2'-deoxy-2'Fluoro
  misc_feature (18)..(19): 2'-O-methyl
  misc_feature (1)..(19): ribonucleotide unmodified or modified as described for this sequence
ggacuacgcgaccucucggtt

SEQ ID NO: 1868 - DNA, 21 bp, Artificial Sequence
  Description of Artificial Sequence: Target Sequence/siNA antisense region (stab08)
  misc_feature (20)..(20): Phosphorothioate or Phosphorodithioate 3'-Internucleotide Linkage (optionally present)
  misc_feature (3)..(4): 2'-deoxy-2'Fluoro
  misc_feature (5)..(6): 2'-O-methyl
  misc_feature (7)..(7): 2'-deoxy-2'Fluoro
  misc_feature (8)..(8): 2'-O-methyl
  misc_feature (9)..(9): 2'-deoxy-2'Fluoro
  misc_feature (10)..(11): 2'-O-methyl
  misc_feature (12)..(17): 2'-deoxy-2'Fluoro
  misc_feature (18)..(19): 2'-O-methyl
  misc_feature (1)..(19): ribonucleotide unmodified or modified as described for this sequence
gaucgacgcgaccucucggtt

SEQ ID NO: 1869 - DNA, 21 bp, Artificial Sequence
  Description of Artificial Sequence: Target Sequence/siNA antisense region (stab08)
  misc_feature (20)..(20): Phosphorothioate or Phosphorodithioate 3'-Internucleotide Linkage (optionally present)
  misc_feature (1)..(1): 2'-deoxy-2'Fluoro
  misc_feature (2)..(2): 2'-O-methyl
  misc_feature (3)..(5): 2'-deoxy-2'Fluoro
  misc_feature (6)..(6): 2'-O-methyl
  misc_feature (7)..(7): 2'-deoxy-2'Fluoro
  misc_feature (8)..(11): 2'-O-methyl
  misc_feature (12)..(14): 2'-deoxy-2'Fluoro
  misc_feature (15)..(15): 2'-O-methyl
  misc_feature (16)..(17): 2'-deoxy-2'Fluoro
  misc_feature (18)..(19): 2'-O-methyl
  misc_feature (1)..(19): ribonucleotide unmodified or modified as described for this sequence
uguccacgggaccuaccggtt

SEQ ID NO: 1870 - DNA, 21 bp, Artificial Sequence
  Description of Artificial Sequence: Target Sequence/siNA sense region (stab07)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(1): 2'-deoxy
  misc_feature (2)..(3): 2'-deoxy-2'Fluoro
  misc_feature (4)..(8): 2'-deoxy
  misc_feature (9)..(9): 2'-deoxy-2'Fluoro
  misc_feature (10)..(10): 2'-deoxy
  misc_feature (11)..(12): 2'-deoxy-2'Fluoro
  misc_feature (13)..(13): 2'-deoxy
  misc_feature (14)..(14): 2'-deoxy-2'Fluoro
  misc_feature (15)..(16): 2'-deoxy
  misc_feature (17)..(17): 2'-deoxy-2'Fluoro
  misc_feature (18)..(18): 2'-deoxy
  misc_feature (19)..(19): 2'-deoxy-2'Fluoro
  misc_feature (1)..(19): ribonucleotide unmodified or modified as described for this sequence
gcuaaaggcguuguggcactt

SEQ ID NO: 1871 - DNA, 21 bp, Artificial Sequence
  Description of Artificial Sequence: Target Sequence/siNA sense region (stab07)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(1): 2'-deoxy
  misc_feature (2)..(2): 2'-deoxy-2'Fluoro
  misc_feature (3)..(3): 2'-deoxy
  misc_feature (4)..(4): 2'-deoxy-2'Fluoro
  misc_feature (5)..(8): 2'-deoxy
  misc_feature (9)..(12): 2'-deoxy-2'Fluoro
  misc_feature (13)..(13): 2'-deoxy
  misc_feature (14)..(14): 2'-deoxy-2'Fluoro
  misc_feature (15)..(16): 2'-deoxy
  misc_feature (17)..(17): 2'-deoxy-2'Fluoro
  misc_feature (18)..(19): 2'-deoxy
  misc_feature (1)..(19): ribonucleotide unmodified or modified as described for this sequence
gcguaaggcccugugguaatt

SEQ ID NO: 1872 - DNA, 21 bp, Artificial Sequence
  Description of Artificial Sequence: Target Sequence/siNA sense region (stab07)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(6): 2'-deoxy
  misc_feature (7)..(7): 2'-deoxy-2'Fluoro
  misc_feature (8)..(8): 2'-deoxy
  misc_feature (9)..(11): 2'-deoxy-2'Fluoro
  misc_feature (12)..(13): 2'-deoxy
  misc_feature (14)..(14): 2'-deoxy-2'Fluoro
  misc_feature (15)..(16): 2'-deoxy
  misc_feature (17)..(19): 2'-deoxy-2'Fluoro
  misc_feature (1)..(19): ribonucleotide unmodified or modified as described for this sequence
gagaaacgccuggugguuctt

SEQ ID NO: 1873 - DNA, 21 bp, Artificial Sequence
  Description of Artificial Sequence: Target Sequence/siNA sense region (stab07)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(1): 2'-deoxy-2'Fluoro
  misc_feature (2)..(2): 2'-deoxy
  misc_feature (3)..(3): 2'-deoxy-2'Fluoro
  misc_feature (4)..(7): 2'-deoxy
  misc_feature (8)..(8): 2'-deoxy-2'Fluoro
  misc_feature (9)..(9): 2'-deoxy
  misc_feature (10)..(11): 2'-deoxy-2'Fluoro
  misc_feature (12)..(12): 2'-deoxy
  misc_feature (13)..(13): 2'-deoxy-2'Fluoro
  misc_feature (14)..(15): 2'-deoxy
  misc_feature (16)..(16): 2'-deoxy-2'Fluoro
  misc_feature (17)..(17): 2'-deoxy
  misc_feature (18)..(19): 2'-deoxy-2'Fluoro
  misc_feature (1)..(19): ribonucleotide unmodified or modified as described for this sequence
cguaaggcauuguggcacutt

SEQ ID NO: 1874 - DNA, 21 bp, Artificial Sequence
  Description of Artificial Sequence: Target Sequence/siNA sense region (stab07)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(1): 2'-deoxy-2'Fluoro
  misc_feature (2)..(7): 2'-deoxy
  misc_feature (8)..(8): 2'-deoxy-2'Fluoro
  misc_feature (9)..(9): 2'-deoxy
  misc_feature (10)..(11): 2'-deoxy-2'Fluoro
  misc_feature (12)..(12): 2'-deoxy
  misc_feature (13)..(13): 2'-deoxy-2'Fluoro
  misc_feature (14)..(14): 2'-deoxy
  misc_feature (15)..(16): 2'-deoxy-2'Fluoro
  misc_feature (17)..(17): 2'-deoxy
  misc_feature (18)..(19): 2'-deoxy-2'Fluoro
  misc_feature (1)..(19): ribonucleotide unmodified or modified as described for this sequence
cgagaggcauugugcuacutt

SEQ ID NO: 1875 - DNA, 21 bp, Artificial Sequence
  Description of Artificial Sequence: Target Sequence/siNA sense region (stab07)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(2): 2'-deoxy-2'Fluoro
  misc_feature (3)..(7): 2'-deoxy
  misc_feature (8)..(11): 2'-deoxy-2'Fluoro
  misc_feature (12)..(15): 2'-deoxy
  misc_feature (16)..(16): 2'-deoxy-2'Fluoro
  misc_feature (17)..(17): 2'-deoxy
  misc_feature (18)..(19): 2'-deoxy-2'Fluoro
  misc_feature (1)..(19): ribonucleotide unmodified or modified as described for this sequence
ccaaaggucuugaggugcutt

SEQ ID NO: 1876 - DNA, 21 bp, Artificial Sequence
  Description of Artificial Sequence: Target Sequence/siNA sense region (stab07)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(1): 2'-deoxy-2'Fluoro
  misc_feature (2)..(4): 2'-deoxy
  misc_feature (5)..(5): 2'-deoxy-2'Fluoro
  misc_feature (6)..(8): 2'-deoxy
  misc_feature (9)..(10): 2'-deoxy-2'Fluoro
  misc_feature (11)..(11): 2'-deoxy
  misc_feature (12)..(14): 2'-deoxy-2'Fluoro
  misc_feature (15)..(15): 2'-deoxy
  misc_feature (16)..(16): 2'-deoxy-2'Fluoro
  misc_feature (17)..(19): 2'-deoxy
  misc_feature (1)..(19): ribonucleotide unmodified or modified as described for this sequence
cggauaggcugcuugugagtt

SEQ ID NO: 1877 - DNA, 21 bp, Artificial Sequence
  Description of Artificial Sequence: Target Sequence/siNA sense region (stab07)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(2): 2'-deoxy-2'Fluoro
  misc_feature (3)..(3): 2'-deoxy
  misc_feature (4)..(5): 2'-deoxy-2'Fluoro
  misc_feature (6)..(9): 2'-deoxy
  misc_feature (10)..(10): 2'-deoxy-2'Fluoro
  misc_feature (11)..(11): 2'-deoxy
  misc_feature (12)..(14): 2'-deoxy-2'Fluoro
  misc_feature (15)..(19): 2'-deoxy
  misc_feature (1)..(19): ribonucleotide unmodified or modified as described for this sequence
cugcuaggguacuugggagtt

SEQ ID NO: 1878 - DNA, 21 bp, Artificial Sequence
  Description of Artificial Sequence: Target Sequence/siNA sense region (stab07)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(2): 2'-deoxy-2'Fluoro
  misc_feature (3)..(4): 2'-deoxy
  misc_feature (5)..(5): 2'-deoxy-2'Fluoro
  misc_feature (6)..(6): 2'-deoxy
  misc_feature (7)..(7): 2'-deoxy-2'Fluoro
  misc_feature (8)..(9): 2'-deoxy
  misc_feature (10)..(10): 2'-deoxy-2'Fluoro
  misc_feature (11)..(12): 2'-deoxy
  misc_feature (13)..(14): 2'-deoxy-2'Fluoro
  misc_feature (15)..(15): 2'-deoxy
  misc_feature (16)..(16): 2'-deoxy-2'Fluoro
  misc_feature (17)..(19): 2'-deoxy
  misc_feature (1)..(19): ribonucleotide unmodified or modified as described for this sequence
ccgauauggugauugcgggtt

SEQ ID NO: 1879 - DNA, 21 bp, Artificial Sequence
  Description of Artificial Sequence: Target Sequence/siNA sense region (stab07)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(1): 2'-deoxy
  misc_feature (2)..(3): 2'-deoxy-2'Fluoro
  misc_feature (4)..(6): 2'-deoxy
  misc_feature (7)..(7): 2'-deoxy-2'Fluoro
  misc_feature (8)..(8): 2'-deoxy
  misc_feature (9)..(10): 2'-deoxy-2'Fluoro
  misc_feature (11)..(12): 2'-deoxy
  misc_feature (13)..(13): 2'-deoxy-2'Fluoro
  misc_feature (14)..(16): 2'-deoxy
  misc_feature (17)..(17): 2'-deoxy-2'Fluoro
  misc_feature (18)..(18): 2'-deoxy
  misc_feature (19)..(19): 2'-deoxy-2'Fluoro
  misc_feature (1)..(19): ribonucleotide unmodified or modified as described for this sequence
auugggugcuggcgaguactt

SEQ ID NO: 1880 - DNA, 21 bp, Artificial Sequence
  Description of Artificial Sequence: Target Sequence/siNA sense region (stab07)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(1): 2'-deoxy
  misc_feature (2)..(2): 2'-deoxy-2'Fluoro
  misc_feature (3)..(3): 2'-deoxy
  misc_feature (4)..(4): 2'-deoxy-2'Fluoro
  misc_feature (5)..(6): 2'-deoxy
  misc_feature (7)..(7): 2'-deoxy-2'Fluoro
  misc_feature (8)..(8): 2'-deoxy
  misc_feature (9)..(11): 2'-deoxy-2'Fluoro
  misc_feature (12)..(12): 2'-deoxy
  misc_feature (13)..(13): 2'-deoxy-2'Fluoro
  misc_feature (14)..(16): 2'-deoxy
  misc_feature (17)..(17): 2'-deoxy-2'Fluoro
  misc_feature (18)..(19): 2'-deoxy
  misc_feature (1)..(19): ribonucleotide unmodified or modified as described for this sequence
auauggugccugcgaguggtt

SEQ ID NO: 1881 - DNA, 21 bp, Artificial Sequence
  Description of Artificial Sequence: Target Sequence/siNA sense region (stab07)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(6): 2'-deoxy
  misc_feature (7)..(7): 2'-deoxy-2'Fluoro
  misc_feature (8)..(8): 2'-deoxy
  misc_feature (9)..(11): 2'-deoxy-2'Fluoro
  misc_feature (12)..(12): 2'-deoxy
  misc_feature (13)..(13): 2'-deoxy-2'Fluoro
  misc_feature (14)..(14): 2'-deoxy
  misc_feature (15)..(15): 2'-deoxy-2'Fluoro
  misc_feature (16)..(16): 2'-deoxy
  misc_feature (17)..(17): 2'-deoxy-2'Fluoro
  misc_feature (18)..(18): 2'-deoxy
  misc_feature (19)..(19): 2'-deoxy-2'Fluoro
  misc_feature (1)..(19): ribonucleotide unmodified or modified as described for this sequence
agaggguacuugcgcgugutt

SEQ ID NO: 1882 - DNA, 21 bp, Artificial Sequence
  Description of Artificial Sequence: Target Sequence/siNA antisense region (stab08)
  misc_feature (20)..(20): Phosphorothioate or Phosphorodithioate 3'-Internucleotide Linkage (optionally present)
  misc_feature (2)..(2): 2'-deoxy-2'Fluoro
  misc_feature (3)..(3): 2'-O-methyl
  misc_feature (4)..(5): 2'-deoxy-2'Fluoro
  misc_feature (6)..(6): 2'-O-methyl
  misc_feature (7)..(7): 2'-deoxy-2'Fluoro
  misc_feature (8)..(9): 2'-O-methyl
  misc_feature (10)..(10): 2'-deoxy-2'Fluoro
  misc_feature (11)..(11): 2'-O-methyl
  misc_feature (12)..(16): 2'-deoxy-2'Fluoro
  misc_feature (17)..(18): 2'-O-methyl
  misc_feature (19)..(19): 2'-deoxy-2'Fluoro
  misc_feature (1)..(19): ribonucleotide unmodified or modified as described for this sequence
gugccacaacgccuuuagctt

SEQ ID NO: 1883 - DNA, 21 bp, Artificial Sequence
  Description of Artificial Sequence: Target Sequence/siNA antisense region (stab08)
  misc_feature (20)..(20): Phosphorothioate or Phosphorodithioate 3'-Internucleotide Linkage (optionally present)
  misc_feature (1)..(2): 2'-deoxy-2'Fluoro
  misc_feature (3)..(3): 2'-O-methyl
  misc_feature (4)..(5): 2'-deoxy-2'Fluoro
  misc_feature (6)..(6): 2'-O-methyl
  misc_feature (7)..(7): 2'-deoxy-2'Fluoro
  misc_feature (8)..(11): 2'-O-methyl
  misc_feature (12)..(15): 2'-deoxy-2'Fluoro
  misc_feature (16)..(16): 2'-O-methyl
  misc_feature (17)..(17): 2'-deoxy-2'Fluoro
  misc_feature (18)..(18): 2'-O-methyl
  misc_feature (19)..(19): 2'-deoxy-2'Fluoro
  misc_feature (1)..(19): ribonucleotide unmodified or modified as described for this sequence
uuaccacagggccuuacgctt

SEQ ID NO: 1884 - DNA, 21 bp, Artificial Sequence
  Description of Artificial Sequence: Target Sequence/siNA antisense region (stab08)
  misc_feature (20)..(20): Phosphorothioate or Phosphorodithioate 3'-Internucleotide Linkage (optionally present)
  misc_feature (4)..(5): 2'-deoxy-2'Fluoro
  misc_feature (6)..(6): 2'-O-methyl
  misc_feature (7)..(8): 2'-deoxy-2'Fluoro
  misc_feature (9)..(11): 2'-O-methyl
  misc_feature (12)..(12): 2'-deoxy-2'Fluoro
  misc_feature (13)..(13): 2'-O-methyl
  misc_feature (14)..(19): 2'-deoxy-2'Fluoro
  misc_feature (1)..(19): ribonucleotide unmodified or modified as described for this sequence
gaaccaccaggcguuucuctt

SEQ ID NO: 1885 - DNA, 21 bp, Artificial Sequence
  Description of Artificial Sequence: Target Sequence/siNA antisense region (stab08)
  misc_feature (20)..(20): Phosphorothioate or Phosphorodithioate 3'-Internucleotide Linkage (optionally present)
  misc_feature (2)..(3): 2'-deoxy-2'Fluoro
  misc_feature (4)..(4): 2'-O-methyl
  misc_feature (5)..(6): 2'-deoxy-2'Fluoro
  misc_feature (7)..(7): 2'-O-methyl
  misc_feature (8)..(8): 2'-deoxy-2'Fluoro
  misc_feature (9)..(10): 2'-O-methyl
  misc_feature (11)..(11): 2'-deoxy-2'Fluoro
  misc_feature (12)..(12): 2'-O-methyl
  misc_feature (13)..(16): 2'-deoxy-2'Fluoro
  misc_feature (17)..(17): 2'-O-methyl
  misc_feature (18)..(18): 2'-deoxy-2'Fluoro
  misc_feature (19)..(19): 2'-O-methyl
  misc_feature (1)..(19): ribonucleotide unmodified or modified as described for this sequence
agugccacaaugccuuacgtt

SEQ ID NO: 1886 - DNA, 21 bp, Artificial Sequence
  Description of Artificial Sequence: Target Sequence/siNA antisense region (stab08)
  misc_feature (20)..(20): Phosphorothioate or Phosphorodithioate 3'-Internucleotide Linkage (optionally present)
  misc_feature (2)..(3): 2'-deoxy-2'Fluoro
  misc_feature (4)..(5): 2'-O-methyl
  misc_feature (6)..(6): 2'-deoxy-2'Fluoro
  misc_feature (7)..(7): 2'-O-methyl
  misc_feature (8)..(8): 2'-deoxy-2'Fluoro
  misc_feature (9)..(10): 2'-O-methyl
  misc_feature (11)..(11): 2'-deoxy-2'Fluoro
  misc_feature (12)..(12): 2'-O-methyl
  misc_feature (13)..(18): 2'-deoxy-2'Fluoro
  misc_feature (19)..(19): 2'-O-methyl
  misc_feature (1)..(19): ribonucleotide unmodified or modified as described for this sequence
aguagcacaaugccucucgtt

SEQ ID NO: 1887 - DNA, 21 bp, Artificial Sequence
  Description of Artificial Sequence: Target Sequence/siNA antisense region (stab08)
  misc_feature (20)..(20): Phosphorothioate or Phosphorodithioate 3'-Internucleotide Linkage (optionally present)
  misc_feature (3)..(3): 2'-deoxy-2'Fluoro
  misc_feature (4)..(4): 2'-O-methyl
  misc_feature (5)..(8): 2'-deoxy-2'Fluoro
  misc_feature (9)..(12): 2'-O-methyl
  misc_feature (13)..(17): 2'-deoxy-2'Fluoro
  misc_feature (18)..(19): 2'-O-methyl
  misc_feature (1)..(19): ribonucleotide unmodified or modified as described for this sequence
agcaccucaagaccuuuggtt

SEQ ID NO: 1888 - DNA, 21 bp, Artificial Sequence
  Description of Artificial Sequence: Target Sequence/siNA antisense region (stab08)
  misc_feature (20)..(20): Phosphorothioate or Phosphorodithioate 3'-Internucleotide Linkage (optionally present)
  misc_feature (1)..(3): 2'-deoxy-2'Fluoro
  misc_feature (4)..(4): 2'-O-methyl
  misc_feature (5)..(5): 2'-deoxy-2'Fluoro
  misc_feature (6)..(8): 2'-O-methyl
  misc_feature (9)..(9): 2'-deoxy-2'Fluoro
  misc_feature (10)..(11): 2'-O-methyl
  misc_feature (12)..(14): 2'-deoxy-2'Fluoro
  misc_feature (15)..(15): 2'-O-methyl
  misc_feature (16)..(18): 2'-deoxy-2'Fluoro
  misc_feature (19)..(19): 2'-O-methyl
  misc_feature (1)..(19): ribonucleotide unmodified or modified as described for this sequence
cucacaagcagccuauccgtt

SEQ ID NO: 1889 - DNA, 21 bp, Artificial Sequence
  Description of Artificial Sequence: Target Sequence/siNA antisense region (stab08)
  misc_feature (20)..(20): Phosphorothioate or Phosphorodithioate 3'-Internucleotide Linkage (optionally present)
  misc_feature (1)..(5): 2'-deoxy-2'Fluoro
  misc_feature (6)..(8): 2'-O-methyl
  misc_feature (9)..(9): 2'-deoxy-2'Fluoro
  misc_feature (10)..(10): 2'-O-methyl
  misc_feature (11)..(14): 2'-deoxy-2'Fluoro
  misc_feature (15)..(16): 2'-O-methyl
  misc_feature (17)..(17): 2'-deoxy-2'Fluoro
  misc_feature (18)..(19): 2'-O-methyl
  misc_feature (1)..(19): ribonucleotide unmodified or modified as described for this sequence
cucccaaguacccuagcagtt

SEQ ID NO: 1890 - DNA, 21 bp, Artificial Sequence
  Description of Artificial Sequence: Target Sequence/siNA antisense region (stab08)
  misc_feature (20)..(20): Phosphorothioate or Phosphorodithioate 3'-Internucleotide Linkage (optionally present)
  misc_feature (1)..(3): 2'-deoxy-2'Fluoro
  misc_feature (4)..(4): 2'-O-methyl
  misc_feature (5)..(5): 2'-deoxy-2'Fluoro
  misc_feature (6)..(7): 2'-O-methyl
  misc_feature (8)..(9): 2'-deoxy-2'Fluoro
  misc_feature (10)..(10): 2'-O-methyl
  misc_feature (11)..(12): 2'-deoxy-2'Fluoro
  misc_feature (13)..(13): 2'-O-methyl
  misc_feature (14)..(14): 2'-deoxy-2'Fluoro
  misc_feature (15)..(15): 2'-O-methyl
  misc_feature (16)..(17): 2'-deoxy-2'Fluoro
  misc_feature (18)..(19): 2'-O-methyl
  misc_feature (1)..(19): ribonucleotide unmodified or modified as described for this sequence
cccgcaaucaccauaucggtt

SEQ ID NO: 1891 - DNA, 21 bp, Artificial Sequence
  Description of Artificial Sequence: Target Sequence/siNA antisense region (stab08)
  misc_feature (20)..(20): Phosphorothioate or Phosphorodithioate 3'-Internucleotide Linkage (optionally present)
  misc_feature (2)..(2): 2'-deoxy-2'Fluoro
  misc_feature (3)..(3): 2'-O-methyl
  misc_feature (4)..(6): 2'-deoxy-2'Fluoro
  misc_feature (7)..(7): 2'-O-methyl
  misc_feature (8)..(9): 2'-deoxy-2'Fluoro
  misc_feature (10)..(11): 2'-O-methyl
  misc_feature (12)..(12): 2'-deoxy-2'Fluoro
  misc_feature (13)..(13): 2'-O-methyl
  misc_feature (14)..(16): 2'-deoxy-2'Fluoro
  misc_feature (17)..(18): 2'-O-methyl
  misc_feature (19)..(19): 2'-deoxy-2'Fluoro
  misc_feature (1)..(19): ribonucleotide unmodified or modified as described for this sequence
guacucgccagcacccaautt

SEQ ID NO: 1892 - DNA, 21 bp, Artificial Sequence
  Description of Artificial Sequence: Target Sequence/siNA antisense region (stab08)
  misc_feature (20)..(20): Phosphorothioate or Phosphorodithioate 3'-Internucleotide Linkage (optionally present)
  misc_feature (1)..(2): 2'-deoxy-2'Fluoro
  misc_feature (3)..(3): 2'-O-methyl
  misc_feature (4)..(6): 2'-deoxy-2'Fluoro
  misc_feature (7)..(7): 2'-O-methyl
  misc_feature (8)..(8): 2'-deoxy-2'Fluoro
  misc_feature (9)..(11): 2'-O-methyl
  misc_feature (12)..(12): 2'-deoxy-2'Fluoro
  misc_feature (13)..(13): 2'-O-methyl
  misc_feature (14)..(15): 2'-deoxy-2'Fluoro
  misc_feature (16)..(16): 2'-O-methyl
  misc_feature (17)..(17): 2'-deoxy-2'Fluoro
  misc_feature (18)..(18): 2'-O-methyl
  misc_feature (19)..(19): 2'-deoxy-2'Fluoro
  misc_feature (1)..(19): ribonucleotide unmodified or modified as described for this sequence
ccacucgcaggcaccauautt

SEQ ID NO: 1893 - DNA, 21 bp, Artificial Sequence
  Description of Artificial Sequence: Target Sequence/siNA antisense region (stab08)
  misc_feature (20)..(20): Phosphorothioate or Phosphorodithioate 3'-Internucleotide Linkage (optionally present)
  misc_feature (2)..(2): 2'-deoxy-2'Fluoro
  misc_feature (3)..(3): 2'-O-methyl
  misc_feature (4)..(4): 2'-deoxy-2'Fluoro
  misc_feature (5)..(5): 2'-O-methyl
  misc_feature (6)..(6): 2'-deoxy-2'Fluoro
  misc_feature (7)..(7): 2'-O-methyl
  misc_feature (8)..(8): 2'-deoxy-2'Fluoro
  misc_feature (9)..(11): 2'-O-methyl
  misc_feature (12)..(12): 2'-deoxy-2'Fluoro
  misc_feature (13)..(13): 2'-O-methyl
  misc_feature (14)..(19): 2'-deoxy-2'Fluoro
  misc_feature (1)..(19): ribonucleotide unmodified or modified as described for this sequence
acacgcgcaaguacccucutt

SEQ ID NO: 1894 - DNA, 21 bp, Artificial Sequence
  Description of Artificial Sequence: Target Sequence/siNA sense region (stab07)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(1): 2'-deoxy-2'Fluoro
  misc_feature (2)..(2): 2'-deoxy
  misc_feature (3)..(3): 2'-deoxy-2'Fluoro
  misc_feature (4)..(5): 2'-deoxy
  misc_feature (6)..(6): 2'-deoxy-2'Fluoro
  misc_feature (7)..(7): 2'-deoxy
  misc_feature (8)..(11): 2'-deoxy-2'Fluoro
  misc_feature (12)..(17): 2'-deoxy
  misc_feature (18)..(18): 2'-deoxy-2'Fluoro
  misc_feature (19)..(19): 2'-deoxy
  misc_feature (1)..(19): ribonucleotide unmodified or modified as described for this sequence
caugguguuccggaaagcgtt

SEQ ID NO: 1895 - DNA, 21 bp, Artificial Sequence
  Description of Artificial Sequence: Target Sequence/siNA sense region (stab07)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(2): 2'-deoxy-2'Fluoro
  misc_feature (3)..(3): 2'-deoxy
  misc_feature (4)..(4): 2'-deoxy-2'Fluoro
  misc_feature (5)..(6): 2'-deoxy
  misc_feature (7)..(7): 2'-deoxy-2'Fluoro
  misc_feature (8)..(8): 2'-deoxy
  misc_feature (9)..(12): 2'-deoxy-2'Fluoro
  misc_feature (13)..(18): 2'-deoxy
  misc_feature (19)..(19): 2'-deoxy-2'Fluoro
  misc_feature (1)..(19): ribonucleotide unmodified or modified as described for this sequence
ucaugguguuccggaaagctt

SEQ ID NO: 1896 - DNA, 21 bp, Artificial Sequence
  Description of Artificial Sequence: Target Sequence/siNA sense region (stab07)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(3): 2'-deoxy
  misc_feature (4)..(4): 2'-deoxy-2'Fluoro
  misc_feature (5)..(5): 2'-deoxy
  misc_feature (6)..(8): 2'-deoxy-2'Fluoro
  misc_feature (9)..(9): 2'-deoxy
  misc_feature (10)..(10): 2'-deoxy-2'Fluoro
  misc_feature (11)..(14): 2'-deoxy
  misc_feature (15)..(15): 2'-deoxy-2'Fluoro
  misc_feature (16)..(17): 2'-deoxy
  misc_feature (18)..(19): 2'-deoxy-2'Fluoro
  misc_feature (1)..(19): ribonucleotide unmodified or modified as described for this sequence
gagcguucgugggauaguctt

SEQ ID NO: 1897 - DNA, 21 bp, Artificial Sequence
  Description of Artificial Sequence: Target Sequence/siNA sense region (stab07)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(1): 2'-deoxy-2'Fluoro
  misc_feature (2)..(2): 2'-deoxy
  misc_feature (3)..(3): 2'-deoxy-2'Fluoro
  misc_feature (4)..(6): 2'-deoxy
  misc_feature (7)..(7): 2'-deoxy-2'Fluoro
  misc_feature (8)..(8): 2'-deoxy
  misc_feature (9)..(11): 2'-deoxy-2'Fluoro
  misc_feature (12)..(12): 2'-deoxy
  misc_feature (13)..(13): 2'-deoxy-2'Fluoro
  misc_feature (14)..(17): 2'-deoxy
  misc_feature (18)..(18): 2'-deoxy-2'Fluoro
  misc_feature (19)..(19): 2'-deoxy
  misc_feature (1)..(19): ribonucleotide unmodified or modified as described for this sequence
cgugagcguucgugggauatt

SEQ ID NO: 1898 - DNA, 21 bp, Artificial Sequence
  Description of Artificial Sequence: Target Sequence/siNA antisense region (stab08)
  misc_feature (20)..(20): Phosphorothioate or Phosphorodithioate 3'-Internucleotide Linkage (optionally present)
  misc_feature (1)..(1): 2'-deoxy-2'Fluoro
  misc_feature (2)..(2): 2'-O-methyl
  misc_feature (3)..(8): 2'-deoxy-2'Fluoro
  misc_feature (9)..(12): 2'-O-methyl
  misc_feature (13)..(13): 2'-deoxy-2'Fluoro
  misc_feature (14)..(14): 2'-O-methyl
  misc_feature (15)..(16): 2'-deoxy-2'Fluoro
  misc_feature (17)..(17): 2'-O-methyl
  misc_feature (18)..(18): 2'-deoxy-2'Fluoro
  misc_feature (19)..(19): 2'-O-methyl
  misc_feature (1)..(19): ribonucleotide unmodified or modified as described for this sequence
cgcuuuccggaacaccaugtt

SEQ ID NO: 1899 - DNA, 21 bp, Artificial Sequence
  Description of Artificial Sequence: Target Sequence/siNA antisense region (stab08)
  misc_feature (20)..(20): Phosphorothioate or Phosphorodithioate 3'-Internucleotide Linkage (optionally present)
  misc_feature (2)..(7): 2'-deoxy-2'Fluoro
  misc_feature (8)..(11): 2'-O-methyl
  misc_feature (12)..(12): 2'-deoxy-2'Fluoro
  misc_feature (13)..(13): 2'-O-methyl
  misc_feature (14)..(15): 2'-deoxy-2'Fluoro
  misc_feature (16)..(16): 2'-O-methyl
  misc_feature (17)..(17): 2'-deoxy-2'Fluoro
  misc_feature (18)..(19): 2'-O-methyl
  misc_feature (1)..(19): ribonucleotide unmodified or modified as described for this sequence
gcuuuccggaacaccaugatt

SEQ ID NO: 1900 - DNA, 21 bp, Artificial Sequence
  Description of Artificial Sequence: Target Sequence/siNA antisense region (stab08)
  misc_feature (20)..(20): Phosphorothioate or Phosphorodithioate 3'-Internucleotide Linkage (optionally present)
  misc_feature (3)..(4): 2'-deoxy-2'Fluoro
  misc_feature (5)..(5): 2'-O-methyl
  misc_feature (6)..(9): 2'-deoxy-2'Fluoro
  misc_feature (10)..(10): 2'-O-methyl
  misc_feature (11)..(11): 2'-deoxy-2'Fluoro
  misc_feature (12)..(14): 2'-O-methyl
  misc_feature (15)..(15): 2'-deoxy-2'Fluoro
  misc_feature (16)..(16): 2'-O-methyl
  misc_feature (17)..(19): 2'-deoxy-2'Fluoro
  misc_feature (1)..(19): ribonucleotide unmodified or modified as described for this sequence
gacuaucccacgaacgcuctt

SEQ ID NO: 1901 - DNA, 21 bp, Artificial Sequence
  Description of Artificial Sequence: Target Sequence/siNA antisense region (stab08)
  misc_feature (20)..(20): Phosphorothioate or Phosphorodithioate 3'-Internucleotide Linkage (optionally present)
  misc_feature (1)..(1): 2'-deoxy-2'Fluoro
  misc_feature (2)..(2): 2'-O-methyl
  misc_feature (3)..(6): 2'-deoxy-2'Fluoro
  misc_feature (7)..(7): 2'-O-methyl
  misc_feature (8)..(8): 2'-deoxy-2'Fluoro
  misc_feature (9)..(11): 2'-O-methyl
  misc_feature (12)..(12): 2'-deoxy-2'Fluoro
  misc_feature (13)..(13): 2'-O-methyl
  misc_feature (14)..(16): 2'-deoxy-2'Fluoro
  misc_feature (17)..(17): 2'-O-methyl
  misc_feature (18)..(18): 2'-deoxy-2'Fluoro
  misc_feature (19)..(19): 2'-O-methyl
  misc_feature (1)..(19): ribonucleotide unmodified or modified as described for this sequence
uaucccacgaacgcucacgtt

SEQ ID NO: 1902 - RNA, 28 nt, Artificial Sequence
  Description of Artificial Sequence: Target Sequence/siNA antisense region
  misc_feature (28)..(28): 3'-3 attached terminal deoxyabasic moiety, inverted abasic, inverted nucleotide or other terminal cap that is optionally present
  misc_feature (1)..(1): Terminal 5' phosphate
ucauacuaacgccauggcguuaguauga

SEQ ID NO: 1903 - RNA, 26 nt, Artificial Sequence
  Description of Artificial Sequence: Target Sequence/siNA antisense region
  misc_feature (26)..(26): 3'-3 attached terminal deoxyabasic moiety, inverted abasic, inverted nucleotide or other terminal cap that is optionally present
  misc_feature (1)..(1): Terminal 5' phosphate
cauacuaacgccauggcguuaguaug

SEQ ID NO: 1904 - RNA, 24 nt, Artificial Sequence
  Description of Artificial Sequence: Target Sequence/siNA antisense region
  misc_feature (24)..(24): 3'-3 attached terminal deoxyabasic moiety, inverted abasic, inverted nucleotide or other terminal cap that is optionally present
  misc_feature (1)..(1): Terminal 5' phosphate
auacuaacgccauggcguuaguau

SEQ ID NO: 1905 - RNA, 22 nt, Artificial Sequence
  Description of Artificial Sequence: Target Sequence/siNA antisense region
  misc_feature (22)..(22): 3'-3 attached terminal deoxyabasic moiety, inverted abasic, inverted nucleotide or other terminal cap that is optionally present
  misc_feature (1)..(1): Terminal 5' phosphate
uacuaacgccauggcguuagua

SEQ ID NO: 1906 - RNA, 28 nt, Artificial Sequence
  Description of Artificial Sequence: Target Sequence/siNA antisense region
  misc_feature (28)..(28): 3'-3 attached terminal deoxyabasic moiety, inverted abasic, inverted nucleotide or other terminal cap that is optionally present
  misc_feature (1)..(1): Terminal 5' phosphate
acuauggcucucccgggagagccauagu

SEQ ID NO: 1907 - RNA, 26 nt, Artificial Sequence
  Description of Artificial Sequence: Target Sequence/siNA antisense region
  misc_feature (26)..(26): 3'-3 attached terminal deoxyabasic moiety, inverted abasic, inverted nucleotide or other terminal cap that is optionally present
  misc_feature (1)..(1): Terminal 5' phosphate
cuauggcucucccgggagagccauag

SEQ ID NO: 1908 - RNA, 24 nt, Artificial Sequence
  Description of Artificial Sequence: Target Sequence/siNA antisense region
  misc_feature (24)..(24): 3'-3 attached terminal deoxyabasic moiety, inverted abasic, inverted nucleotide or other terminal cap that is optionally present
  misc_feature (1)..(1): Terminal 5' phosphate
uauggcucucccgggagagccaua

SEQ ID NO: 1909 - RNA, 22 nt, Artificial Sequence
  Description of Artificial Sequence: Target Sequence/siNA antisense region
  misc_feature (22)..(22): 3'-3 attached terminal deoxyabasic moiety, inverted abasic, inverted nucleotide or other terminal cap that is optionally present
  misc_feature (1)..(1): Terminal 5' phosphate
auggcucucccgggagagccau

SEQ ID NO: 1910 - RNA, 20 nt, Artificial Sequence
  Description of Artificial Sequence: Target Sequence/siNA antisense region
  misc_feature (20)..(20): 3'-3 attached terminal deoxyabasic moiety, inverted abasic, inverted nucleotide or other terminal cap that is optionally present
  misc_feature (1)..(1): Terminal 5' phosphate
uggcucucccgggagagcca

SEQ ID NO: 1911 - RNA, 28 nt, Artificial Sequence
  Description of Artificial Sequence: Target Sequence/siNA antisense region
  misc_feature (28)..(28): 3'-3 attached terminal deoxyabasic moiety, inverted abasic, inverted nucleotide or other terminal cap that is optionally present
  misc_feature (1)..(1): Terminal 5' phosphate
ccgguguacucaccggugaguacaccgg

SEQ ID NO: 1912 - RNA, 26 nt, Artificial Sequence
  Description of Artificial Sequence: Target Sequence/siNA antisense region
  misc_feature (26)..(26): 3'-3 attached terminal deoxyabasic moiety, inverted abasic, inverted nucleotide or other terminal cap that is optionally present
  misc_feature (1)..(1): Terminal 5' phosphate
cgguguacucaccggugaguacaccg

SEQ ID NO: 1913 - RNA, 24 nt, Artificial Sequence
  Description of Artificial Sequence: Target Sequence/siNA antisense region
  misc_feature (24)..(24): 3'-3 attached terminal deoxyabasic moiety, inverted abasic, inverted nucleotide or other terminal cap that is optionally present
  misc_feature (1)..(1): Terminal 5' phosphate
gguguacucaccggugaguacacc

SEQ ID NO: 1914 - RNA, 28 nt, Artificial Sequence
  Description of Artificial Sequence: Target Sequence/siNA antisense region
  misc_feature (28)..(28): 3'-3 attached terminal deoxyabasic moiety, inverted abasic, inverted nucleotide or other terminal cap that is optionally present
  misc_feature (1)..(1): Terminal 5' phosphate
cuacgagaccucccgggaggucucguag

SEQ ID NO: 1915 - RNA, 26 nt, Artificial Sequence
  Description of Artificial Sequence: Target Sequence/siNA antisense region
  misc_feature (26)..(26): 3'-3 attached terminal deoxyabasic moiety, inverted abasic, inverted nucleotide or other terminal cap that is optionally present
  misc_feature (1)..(1): Terminal 5' phosphate
uacgagaccucccgggaggucucgua

SEQ ID NO: 1916 - RNA, 24 nt, Artificial Sequence
  Description of Artificial Sequence: Target Sequence/siNA antisense region
  misc_feature (24)..(24): 3'-3 attached terminal deoxyabasic moiety, inverted abasic, inverted nucleotide or other terminal cap that is optionally present
  misc_feature (1)..(1): Terminal 5' phosphate
acgagaccucccgggaggucucgu

SEQ ID NO: 1917 - DNA, 21 bp, Artificial Sequence
  Description of Artificial Sequence: Target Sequence/siNA antisense region (stab19)
  misc_feature (21)..(21): 3'-3 attached terminal deoxyabasic moiety, inverted abasic, inverted nucleotide or other terminal cap that is optionally present
  misc_feature (3)..(5): 2'-deoxy-2'Fluoro
  misc_feature (7)..(7): 2'-deoxy-2'Fluoro
  misc_feature (12)..(17): 2'-deoxy-2'Fluoro
  misc_feature (1)..(19): ribonucleotide unmodified or modified as described for this sequence
ggucuacgagaccucccggtt

SEQ ID NO: 1918 - DNA, 21 bp, Artificial Sequence
  Description of Artificial Sequence: Target Sequence/siNA antisense region (stab19)
  misc_feature (21)..(21): 3'-3 attached terminal deoxyabasic moiety, inverted abasic, inverted nucleotide or other terminal cap that is optionally present
  misc_feature (3)..(8): 2'-deoxy-2'Fluoro
  misc_feature (13)..(13): 2'-deoxy-2'Fluoro
  misc_feature (15)..(17): 2'-deoxy-2'Fluoro
  misc_feature (1)..(19): ribonucleotide unmodified or modified as described for this sequence
ggcccuccagagcaucuggtt

SEQ ID NO: 1919 - DNA, 21 bp, Artificial Sequence
  Description of Artificial Sequence: Target Sequence/siNA antisense region (stab19)
  misc_feature (21)..(21): 3'-3 attached terminal deoxyabasic moiety, inverted abasic, inverted nucleotide or other terminal cap that is optionally present
  misc_feature (1)..(3): 2'-deoxy-2'Fluoro
  misc_feature (5)..(5): 2'-deoxy-2'Fluoro
  misc_feature (9)..(9): 2'-deoxy-2'Fluoro
  misc_feature (11)..(14): 2'-deoxy-2'Fluoro
  misc_feature (16)..(17): 2'-deoxy-2'Fluoro
  misc_feature (1)..(19): ribonucleotide unmodified or modified as described for this sequence
cucgcaagcacccuaucagtt

SEQ ID NO: 1920 - DNA, 21 bp, Artificial Sequence
  Description of Artificial Sequence: Target Sequence/siNA antisense region (stab19)
  misc_feature (21)..(21): 3'-3 attached terminal deoxyabasic moiety, inverted abasic, inverted nucleotide or other terminal cap that is optionally present
  misc_feature (3)..(4): 2'-deoxy-2'Fluoro
  misc_feature (6)..(9): 2'-deoxy-2'Fluoro
  misc_feature (11)..(11): 2'-deoxy-2'Fluoro
  misc_feature (15)..(15): 2'-deoxy-2'Fluoro
  misc_feature (17)..(19): 2'-deoxy-2'Fluoro
  misc_feature (1)..(19): ribonucleotide unmodified or modified as described for this sequence
gacuaucccacgaacgcuctt

SEQ ID NO: 1921 - DNA, 21 bp, Artificial Sequence
  Description of Artificial Sequence: Target Sequence/siNA sense region (stab00)
  misc_feature (1)..(19): ribonucleotide unmodified or modified as described for this sequence
gcgaaaggccuugugguactt

SEQ ID NO: 1922 - DNA, 21 bp, Artificial Sequence
  Description of Artificial Sequence: Target Sequence/siNA sense region (stab00)
  misc_feature (1)..(19): ribonucleotide unmodified or modified as described for this sequence
cgaaaggccuugugguacutt

SEQ ID NO: 1923 - DNA, 21 bp, Artificial Sequence
  Description of Artificial Sequence: Target Sequence/siNA sense region (stab00)
  misc_feature (1)..(19): ribonucleotide unmodified or modified as described for this sequence
cugauagggugcuugcgagtt

SEQ ID NO: 1924 - DNA, 21 bp, Artificial Sequence
  Description of Artificial Sequence: Target Sequence/siNA sense region (stab00)
  misc_feature (1)..(19): ribonucleotide unmodified or modified as described for this sequence
auagggugcuugcgagugctt

SEQ ID NO: 1925 - DNA, 21 bp, Artificial Sequence
  Description of Artificial Sequence: Target Sequence/siNA sense region (stab00)
  misc_feature (1)..(19): ribonucleotide unmodified or modified as described for this sequence
ccgggaggucucguagacctt

SEQ ID NO: 1926 - DNA, 21 bp, Artificial Sequence
  Description of Artificial Sequence: Target Sequence/siNA antisense region (stab00)
  misc_feature (1)..(19): ribonucleotide unmodified or modified as described for this sequence
guaccacaaggccuuucgctt

SEQ ID NO: 1927 - DNA, 21 bp, Artificial Sequence
  Description of Artificial Sequence: Target Sequence/siNA antisense region (stab00)
  misc_feature (1)..(19): ribonucleotide unmodified or modified as described for this sequence
aguaccacaaggccuuucgtt

SEQ ID NO: 1928 - DNA, 21 bp, Artificial Sequence
  Description of Artificial Sequence: Target Sequence/siNA antisense region (stab00)
  misc_feature (1)..(19): ribonucleotide unmodified or modified as described for this sequence
cucgcaagcacccuaucagtt

SEQ ID NO: 1929 - DNA, 21 bp, Artificial Sequence
  Description of Artificial Sequence: Target Sequence/siNA antisense region (stab00)
  misc_feature (1)..(19): ribonucleotide unmodified or modified as described for this sequence
gcacucgcaagcacccuautt

SEQ ID NO: 1930 - DNA, 21 bp, Artificial Sequence
  Description of Artificial Sequence: Target Sequence/siNA sense region (stab00)
  misc_feature (1)..(19): ribonucleotide unmodified or modified as described for this sequence
caugguguuccggaaagcgtt

SEQ ID NO: 1931 - DNA, 21 bp, Artificial Sequence
  Description of Artificial Sequence: Target Sequence/siNA sense region (stab00)
  misc_feature (1)..(19): ribonucleotide unmodified or modified as described for this sequence
ucaugguguuccggaaagctt

SEQ ID NO: 1932 - DNA, 21 bp, Artificial Sequence
  Description of Artificial Sequence: Target Sequence/siNA sense region (stab00)
  misc_feature (1)..(19): ribonucleotide unmodified or modified as described for this sequence
gagcguucgugggauaguctt

SEQ ID NO: 1933 - DNA, 21 bp, Artificial Sequence
  Description of Artificial Sequence: Target Sequence/siNA sense region (stab00)
  misc_feature (1)..(19): ribonucleotide unmodified or modified as described for this sequence
cgugagcguucgugggauatt

SEQ ID NO: 1934 - DNA, 21 bp, Artificial Sequence
  Description of Artificial Sequence: Target Sequence/siNA sense region (stab00)
  misc_feature (1)..(19): ribonucleotide unmodified or modified as described for this sequence
ccagaugcucuggagggcctt

SEQ ID NO: 1935 - DNA, 21 bp, Artificial Sequence
  Description of Artificial Sequence: Target Sequence/siNA antisense region (stab00)
  misc_feature (1)..(19): ribonucleotide unmodified or modified as described for this sequence
cgcuuuccggaacaccaugtt

SEQ ID NO: 1936 - DNA, 21 bp, Artificial Sequence
  Description of Artificial Sequence: Target Sequence/siNA antisense region (stab00)
  misc_feature (1)..(19): ribonucleotide unmodified or modified as described for this sequence
gcuuuccggaacaccaugatt

SEQ ID NO: 1937 - DNA, 21 bp, Artificial Sequence
  Description of Artificial Sequence: Target Sequence/siNA antisense region (stab00)
  misc_feature (1)..(19): ribonucleotide unmodified or modified as described for this sequence
gacuaucccacgaacgcuctt

SEQ ID NO: 1938 - DNA, 21 bp, Artificial Sequence
  Description of Artificial Sequence: Target Sequence/siNA antisense region (stab00)
  misc_feature (1)..(19): ribonucleotide unmodified or modified as described for this sequence
uaucccacgaacgcucacgtt

SEQ ID NO: 1939 - DNA, 21 bp, Artificial Sequence
  Description of Artificial Sequence: Target Sequence/siNA antisense region (stab00)
  misc_feature (1)..(19): ribonucleotide unmodified or modified as described for this sequence
ggcccuccagagcaucuggtt

SEQ ID NO: 1940 - DNA, 21 bp, Artificial Sequence
  Description of Artificial Sequence: Target Sequence/siNA sense region (stab07)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(2): 2'-deoxy-2'Fluoro
  misc_feature (9)..(12): 2'-deoxy-2'Fluoro
  misc_feature (1)..(19): ribonucleotide unmodified or modified as described for this sequence
ccgggaggucucguagacctt

SEQ ID NO: 1941 - DNA, 21 bp, Artificial Sequence
  Description of Artificial Sequence: Target Sequence/siNA antisense region (stab08)
  misc_feature (20)..(20): Phosphorothioate or Phosphorodithioate 3'-Internucleotide Linkage (optionally present)
  misc_feature (6)..(6): 2'-O-methyl
  misc_feature (7)..(7): 2'-deoxy-2'Fluoro
  misc_feature (8)..(11): 2'-O-methyl
  misc_feature (12)..(17): 2'-deoxy-2'Fluoro
  misc_feature (18)..(19): 2'-O-methyl
  misc_feature (1)..(19): ribonucleotide unmodified or modified as described for this sequence
ggucuacgagaccucccggtt

SEQ ID NO: 1942 - DNA, 21 bp, Artificial Sequence
  Description of Artificial Sequence: Target Sequence/siNA antisense region (stab25)
  misc_feature (20)..(20): Phosphorothioate or Phosphorodithioate 3'-Internucleotide Linkage (optionally present)
  misc_feature (4)..(5): 2'-deoxy-2'Fluoro
  misc_feature (6)..(6): 2'-O-methyl
  misc_feature (7)..(7): 2'-deoxy-2'Fluoro
  misc_feature (8)..(11): 2'-O-methyl
  misc_feature (12)..(17): 2'-deoxy-2'Fluoro
  misc_feature (18)..(19): 2'-O-methyl
  misc_feature (1)..(19): ribonucleotide unmodified or modified as described for this sequence
ggucuacgagaccucccggtt

SEQ ID NO: 1943 - DNA, 21 bp, Artificial Sequence
  Description of Artificial Sequence: Target Sequence/siNA antisense region (stab08)
  misc_feature (20)..(20): Phosphorothioate or Phosphorodithioate 3'-Internucleotide Linkage (optionally present)
  misc_feature (3)..(5): 2'-deoxy-2'Fluoro
  misc_feature (6)..(6): 2'-O-methyl
  misc_feature (7)..(7): 2'-deoxy-2'Fluoro
  misc_feature (8)..(11): 2'-O-methyl
  misc_feature (12)..(17): 2'-deoxy-2'Fluoro
  misc_feature (18)..(19): 2'-O-methyl
  misc_feature (1)..(19): ribonucleotide unmodified or modified as described for this sequence
ggucuacgagaccucccggtt

SEQ ID NO: 1944 - DNA, 21 bp, Artificial Sequence
  Description of Artificial Sequence: Target Sequence/siNA antisense region (stab24)
  misc_feature (20)..(20): Phosphorothioate or Phosphorodithioate 3'-Internucleotide Linkage (optionally present)
  misc_feature (3)..(5): 2'-deoxy-2'Fluoro
  misc_feature (6)..(6): 2'-O-methyl
  misc_feature (7)..(7): 2'-deoxy-2'Fluoro
  misc_feature (8)..(11): 2'-O-methyl
  misc_feature (12)..(17): 2'-deoxy-2'Fluoro
  misc_feature (18)..(19): 2'-O-methyl
  misc_feature (1)..(19): ribonucleotide unmodified or modified as described for this sequence
ggucuacgagaccucccggtt

SEQ ID NO: 1945 - DNA, 21 bp, Artificial Sequence
  Description of Artificial Sequence: Target Sequence/siNA sense region (stab07)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(2): 2'-deoxy-2'Fluoro
  misc_feature (3)..(4): 2'-deoxy
  misc_feature (5)..(5): 2'-deoxy-2'Fluoro
  misc_feature (6)..(9): 2'-deoxy
  misc_feature (10)..(10): 2'-deoxy-2'Fluoro
  misc_feature (11)..(11): 2'-deoxy
  misc_feature (12)..(13): 2'-deoxy-2'Fluoro
  misc_feature (15)..(15): 2'-deoxy
  misc_feature (17)..(19): 2'-deoxy
  misc_feature (1)..(19): ribonucleotide unmodified or modified as described for this sequence
cugauagggugcuugcgagtt

SEQ ID NO: 1946 - DNA, 21 bp, Artificial Sequence
  Description of Artificial Sequence: Target Sequence/siNA antisense region (stab08)
  misc_feature (20)..(20): Phosphorothioate or Phosphorodithioate 3'-Internucleotide Linkage (optionally present)
  misc_feature (4)..(4): 2'-O-methyl
  misc_feature (6)..(8): 2'-O-methyl
  misc_feature (9)..(9): 2'-deoxy-2'Fluoro
  misc_feature (10)..(10): 2'-O-methyl
  misc_feature (11)..(14): 2'-deoxy-2'Fluoro
  misc_feature (15)..(15): 2'-O-methyl
  misc_feature (16)..(17): 2'-deoxy-2'Fluoro
  misc_feature (18)..(19): 2'-O-methyl
  misc_feature (1)..(19): ribonucleotide unmodified or modified as described for this sequence
cucgcaagcacccuaucagtt

SEQ ID NO: 1947 - DNA, 21 bp, Artificial Sequence
  Description of Artificial Sequence: Target Sequence/siNA antisense region (stab25)
  misc_feature (20)..(20): Phosphorothioate or Phosphorodithioate 3'-Internucleotide Linkage (optionally present)
  misc_feature (4)..(4): 2'-O-methyl
  misc_feature (5)..(5): 2'-deoxy-2'Fluoro
  misc_feature (6)..(8): 2'-O-methyl
  misc_feature (9)..(9): 2'-deoxy-2'Fluoro
  misc_feature (10)..(10): 2'-O-methyl
  misc_feature (11)..(14): 2'-deoxy-2'Fluoro
  misc_feature (15)..(15): 2'-O-methyl
  misc_feature (16)..(17): 2'-deoxy-2'Fluoro
  misc_feature (18)..(19): 2'-O-methyl
  misc_feature (1)..(19): ribonucleotide unmodified or modified as described for this sequence
cucgcaagcacccuaucagtt

SEQ ID NO: 1948 - DNA, 21 bp, Artificial Sequence
  Description of Artificial Sequence: Target Sequence/siNA antisense region (stab08)
  misc_feature (20)..(20): Phosphorothioate or Phosphorodithioate 3'-Internucleotide Linkage (optionally present)
  misc_feature (3)..(3): 2'-deoxy-2'Fluoro
  misc_feature (4)..(4): 2'-O-methyl
  misc_feature (5)..(5): 2'-deoxy-2'Fluoro
  misc_feature (6)..(8): 2'-O-methyl
  misc_feature (9)..(9): 2'-deoxy-2'Fluoro
  misc_feature (10)..(10): 2'-O-methyl
  misc_feature (11)..(14): 2'-deoxy-2'Fluoro
  misc_feature (15)..(15): 2'-O-methyl
  misc_feature (16)..(17): 2'-deoxy-2'Fluoro
  misc_feature (18)..(19): 2'-O-methyl
  misc_feature (1)..(19): ribonucleotide unmodified or modified as described for this sequence
cucgcaagcacccuaucagtt

SEQ ID NO: 1949 - DNA, 21 bp, Artificial Sequence
  Description of Artificial Sequence: Target Sequence/siNA antisense region (stab24)
  misc_feature (20)..(20): Phosphorothioate or Phosphorodithioate 3'-Internucleotide Linkage (optionally present)
  misc_feature (2)..(3): 2'-deoxy-2'Fluoro
  misc_feature (4)..(4): 2'-O-methyl
  misc_feature (5)..(5): 2'-deoxy-2'Fluoro
  misc_feature (6)..(8): 2'-O-methyl
  misc_feature (9)..(9): 2'-deoxy-2'Fluoro
  misc_feature (10)..(10): 2'-O-methyl
  misc_feature (11)..(14): 2'-deoxy-2'Fluoro
  misc_feature (15)..(15): 2'-O-methyl
  misc_feature (16)..(17): 2'-deoxy-2'Fluoro
  misc_feature (18)..(19): 2'-O-methyl
  misc_feature (1)..(19): ribonucleotide unmodified or modified as described for this sequence
cucgcaagcacccuaucagtt

SEQ ID NO: 1950 - RNA, 38 nt, Artificial Sequence
  Description of Artificial Sequence: Target Sequence/siNA STRAND region (stab0)
ggucuacgagaccucccggccgggaggucucguagacc

SEQ ID NO: 1951 - DNA, 40 bp, Artificial Sequence
  Description of Artificial Sequence: Target Sequence/siNA STRAND region (stab0)
  misc_feature (1)..(38): ribonucleotide unmodified or modified as described for this sequence
ggucuacgagaccucccggccgggaggucucguagacctt

SEQ ID NO: 1952 - RNA, 36 nt, Artificial Sequence
  Description of Artificial Sequence: Target Sequence/siNA STRAND region (stab0)
ggucuacgagaccucccgcgggaggucucguagacc

SEQ ID NO: 1953 - DNA, 38 bp, Artificial Sequence
  Description of Artificial Sequence: Target Sequence/siNA STRAND region (stab0)
  misc_feature (1)..(36): ribonucleotide unmodified or modified as described for this sequence
ggucuacgagaccucccgcgggaggucucguagacctt

SEQ ID NO: 1954 - RNA, 34 nt, Artificial Sequence
  Description of Artificial Sequence: Target Sequence/siNA STRAND region (stab0)
ggucuacgagaccucccgggaggucucguagacc

SEQ ID NO: 1955 - DNA, 36 bp, Artificial Sequence
  Description of Artificial Sequence: Target Sequence/siNA STRAND region (stab0)
  misc_feature (1)..(34): ribonucleotide unmodified or modified as described for this sequence
ggucuacgagaccucccgggaggucucguagacctt

SEQ ID NO: 1956 - RNA, 32 nt, Artificial Sequence
  Description of Artificial Sequence: Target Sequence/siNA STRAND region (stab0)
ggucuacgagaccuccggaggucucguagacc

SEQ ID NO: 1957 - DNA, 34 bp, Artificial Sequence
  Description of Artificial Sequence: Target Sequence/siNA STRAND region (stab0)
  misc_feature (1)..(32): ribonucleotide unmodified or modified as described for this sequence
ggucuacgagaccuccggaggucucguagacctt

SEQ ID NO: 1958 - RNA, 32 nt, Artificial Sequence
  Description of Artificial Sequence: Target Sequence/siNA STRAND region (stab0)
gucuacgagaccucccgggaggucucguagac

SEQ ID NO: 1959 - DNA, 34 bp, Artificial Sequence
  Description of Artificial Sequence: Target Sequence/siNA STRAND region (stab0)
  misc_feature (1)..(32): ribonucleotide unmodified or modified as described for this sequence
gucuacgagaccucccgggaggucucguagactt

SEQ ID NO: 1960 - RNA, 30 nt, Artificial Sequence
  Description of Artificial Sequence: Target Sequence/siNA STRAND region (stab0)
ucuacgagaccucccgggaggucucguaga

SEQ ID NO: 1961 - DNA, 32 bp, Artificial Sequence
  Description of Artificial Sequence: Target Sequence/siNA STRAND region (stab0)
  misc_feature (1)..(30): ribonucleotide unmodified or modified as described for this sequence
ucuacgagaccucccgggaggucucguagatt

SEQ ID NO: 1962 - RNA, 28 nt, Artificial Sequence
  Description of Artificial Sequence: Target Sequence/siNA STRAND region (stab0)
cuacgagaccucccgggaggucucguag

SEQ ID NO: 1963 - DNA, 30 bp, Artificial Sequence
  Description of Artificial Sequence: Target Sequence/siNA STRAND region (stab0)
  misc_feature (1)..(28): ribonucleotide unmodified or modified as described for this sequence
cuacgagaccucccgggaggucucguagtt

SEQ ID NO: 1964 - RNA, 30 nt, Artificial Sequence
  Description of Artificial Sequence: Target Sequence/siNA STRAND region (stab0)
ggucuacgagaccuccaggucucguagacc

SEQ ID NO: 1965 - DNA, 32 bp, Artificial Sequence
  Description of Artificial Sequence: Target Sequence/siNA STRAND region (stab0)
  misc_feature (1)..(30): ribonucleotide unmodified or modified as described for this sequence
ggucuacgagaccuccaggucucguagacctt

SEQ ID NO: 1966 - RNA, 30 nt, Artificial Sequence
  Description of Artificial Sequence: Target Sequence/siNA STRAND region (stab0)
ggucuacgagaccucgaggucucguagacc

SEQ ID NO: 1967 - DNA, 32 bp, Artificial Sequence
  Description of Artificial Sequence: Target Sequence/siNA STRAND region (stab0)
  misc_feature (1)..(30): ribonucleotide unmodified or modified as described for this sequence
ggucuacgagaccucgaggucucguagacctt

SEQ ID NO: 1968 - RNA, 30 nt, Artificial Sequence
  Description of Artificial Sequence: Target Sequence/siNA STRAND region (stab0)
ggucuacgagaccugcaggucucguagacc

SEQ ID NO: 1969 - DNA, 32 bp, Artificial Sequence
  Description of Artificial Sequence: Target Sequence/siNA STRAND region (stab0)
  misc_feature (1)..(30): ribonucleotide unmodified or modified as described for this sequence
ggucuacgagaccugcaggucucguagacctt

SEQ ID NO: 1970 - DNA, 40 bp, Artificial Sequence
  Description of Artificial Sequence: Target Sequence/siNA STRAND region (stab0)
  misc_feature (1)..(38): ribonucleotide unmodified or modified as described for this sequence
gacuaucccacgaacgcucgagcguucgugggauaguctt

SEQ ID NO: 1971 - RNA, 38 nt, Artificial Sequence
  Description of Artificial Sequence: Target Sequence/siNA STRAND region (stab0)
gacuaucccacgaacgcucgagcguucgugggauaguc

SEQ ID NO: 1972 - DNA, 34 bp, Artificial Sequence
  Description of Artificial Sequence: Target Sequence/siNA STRAND region (stab0)
  misc_feature (1)..(32): ribonucleotide unmodified or modified as described for this sequence
gacuaucccacgaacgcguucgugggauaguctt

SEQ ID NO: 1973 - RNA, 32 nt, Artificial Sequence
  Description of Artificial Sequence: Target Sequence/siNA STRAND region (stab0)
gacuaucccacgaacgcguucgugggauaguc

SEQ ID NO: 1974 - DNA, 32 bp, Artificial Sequence
  Description of Artificial Sequence: Target Sequence/siNA STRAND region (stab0)
  misc_feature (1)..(30): ribonucleotide unmodified or modified as described for this sequence
gacuaucccacgaacguucgugggauaguctt

SEQ ID NO: 1975 - RNA, 30 nt, Artificial Sequence
  Description of Artificial Sequence: Target Sequence/siNA STRAND region (stab0)
gacuaucccacgaacguucgugggauaguc

SEQ ID NO: 1976 - DNA, 30 bp, Artificial Sequence
  Description of Artificial Sequence: Target Sequence/siNA STRAND region (stab0)
  misc_feature (1)..(28): ribonucleotide unmodified or modified as described for this sequence
acuaucccacgaacguucgugggauagutt

SEQ ID NO: 1977 - RNA, 24 nt, Artificial Sequence
  Description of Artificial Sequence: Target Sequence/siNA STRAND region (stab0)
acuaucccacgaacguucguggga

SEQ ID NO: 1978 - DNA, 42 bp, Artificial Sequence
  Description of Artificial Sequence: Target Sequence/siNA sense region (stab00)
  misc_feature (21)..(21): hexethelyne glycol spacer (language)
  misc_feature (1)..(40): ribonucleotide unmodified or modified as described for this sequence
ccgggaggucucguagaccttgcgaaaggccuugugguactt

SEQ ID NO: 1979 - DNA, 42 bp, Artificial Sequence
  Description of Artificial Sequence: Target Sequence/siNA sense region (stab00)
  misc_feature (21)..(21): hexethelyne glycol spacer (language)
  misc_feature (1)..(40): ribonucleotide unmodified or modified as described for this sequence
ccgggaggucucguagaccttauagggugcuugcgagugctt

SEQ ID NO: 1980 - DNA, 42 bp, Artificial Sequence
  Description of Artificial Sequence: Target Sequence/siNA sense region (stab00)
  misc_feature (21)..(21): hexethelyne glycol spacer (language)
  misc_feature (1)..(40): ribonucleotide unmodified or modified as described for this sequence
auagggugcuugcgagugcttgcgaaaggccuugugguactt

SEQ ID NO: 1981 - DNA, 21 bp, Artificial Sequence
  Description of Artificial Sequence: Target Sequence/siNA sense region (stab09)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(19): ribonucleotide unmodified or modified as described for this sequence
cugauagggugcuugcgagtt

SEQ ID NO: 1982 - DNA, 21 bp, Artificial Sequence
  Description of Artificial Sequence: Target Sequence/siNA antisense region (stab10)
  misc_feature (20)..(20): Phosphorothioate or Phosphorodithioate 3'-Internucleotide Linkage (optionally present)
  misc_feature (1)..(19): ribonucleotide unmodified or modified as described for this sequence
cucgcaagcacccuaucagtt

SEQ ID NO: 1983 - DNA, 21 bp, Artificial Sequence
  Description of Artificial Sequence: Target Sequence/siNA sense region (stab04)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(2): 2'-deoxy-2'Fluoro
  misc_feature (5)..(5): 2'-deoxy-2'Fluoro
  misc_feature (10)..(10): 2'-deoxy-2'Fluoro
  misc_feature (12)..(14): 2'-deoxy-2'Fluoro
  misc_feature (16)..(16): 2'-deoxy-2'Fluoro
  misc_feature (1)..(19): ribonucleotide unmodified or modified as described for this sequence
cugauagggugcuugcgagtt

SEQ ID NO: 1984 - DNA, 21 bp, Artificial Sequence
  Description of Artificial Sequence: Target Sequence/siNA antisense region (stab05)
  misc_feature (20)..(20): Phosphorothioate or Phosphorodithioate 3'-Internucleotide Linkage (optionally present)
  misc_feature (1)..(3): 2'-deoxy-2'Fluoro
  misc_feature (5)..(5): 2'-deoxy-2'Fluoro
  misc_feature (9)..(9): 2'-deoxy-2'Fluoro
  misc_feature (11)..(14): 2'-deoxy-2'Fluoro
  misc_feature (16)..(17): 2'-deoxy-2'Fluoro
  misc_feature (1)..(19): ribonucleotide unmodified or modified as described for this sequence
cucgcaagcacccuaucagtt

SEQ ID NO: 1985 - DNA, 42 bp, Artificial Sequence; identical to SEQ ID NO: 1979
  Description of Artificial Sequence: Target Sequence/siNA sense region (stab07)
  misc_feature (1)..(1): 5'-3 attached terminal deoxyabasic moiety, inverted abasic, inverted nucleotide or other terminal cap that is optionally present
  misc_feature (42)..(42): 3'-3 attached terminal deoxyabasic moiety, inverted abasic, inverted nucleotide or other terminal cap that is optionally present
  misc_feature (1)..(2): 2'-deoxy-2'Fluoro
  misc_feature (3)..(8): 2'-deoxy
  misc_feature (9)..(12): 2'-deoxy-2'Fluoro
  misc_feature (13)..(13): 2'-deoxy
  misc_feature (14)..(14): 2'-deoxy-2'Fluoro
  misc_feature (15)..(17): 2'-deoxy
  misc_feature (18)..(19): 2'-deoxy-2'Fluoro
  misc_feature (21)..(21): hexethelyne glycol spacer (language)
  misc_feature (23)..(23): 2'-deoxy-2'Fluoro
  misc_feature (28)..(28): 2'-deoxy-2'Fluoro
  misc_feature (30)..(32): 2'-deoxy-2'Fluoro
  misc_feature (34)..(34): 2'-deoxy-2'Fluoro
  misc_feature (38)..(38): 2'-deoxy-2'Fluoro
  misc_feature (40)..(40): 2'-deoxy-2'Fluoro
  misc_feature (1)..(40): ribonucleotide unmodified or modified as described for this sequence

SEQ ID NO: 1986 - DNA, 21 bp, Artificial Sequence
  Description of Artificial Sequence: Target Sequence/siNA antisense region (stab26)
  misc_feature (3)..(3): 2'-O-methyl
  misc_feature (4)..(6): 2'-deoxy-2'Fluoro
  misc_feature (7)..(7): 2'-O-methyl
  misc_feature (8)..(8): 2'-deoxy-2'Fluoro
  misc_feature (9)..(11): 2'-O-methyl
  misc_feature (12)..(12): 2'-deoxy-2'Fluoro
  misc_feature (13)..(13): 2'-O-methyl
  misc_feature (14)..(17): 2'-deoxy-2'Fluoro
  misc_feature (18)..(18): 2'-O-methyl
  misc_feature (19)..(19): 2'-deoxy-2'Fluoro
  misc_feature (1)..(19): ribonucleotide unmodified or modified as described for this sequence
gcacucgcaagcacccuautt

SEQ ID NO: 1987 - DNA, 21 bp, Artificial Sequence
  Description of Artificial Sequence: Target Sequence/siNA antisense region (stab26)
  misc_feature (4)..(5): 2'-deoxy-2'Fluoro
  misc_feature (6)..(6): 2'-O-methyl
  misc_feature (7)..(7): 2'-deoxy-2'Fluoro
  misc_feature (8)..(11): 2'-O-methyl
  misc_feature (12)..(17): 2'-deoxy-2'Fluoro
  misc_feature (18)..(19): 2'-O-methyl
  misc_feature (1)..(19): ribonucleotide unmodified or modified as described for this sequence
ggucuacgagaccucccggtt

SEQ ID NO: 1988 - DNA, 21 bp, Artificial Sequence
  Description of Artificial Sequence: Target Sequence/siNA antisense region (stab25)
  misc_feature (20)..(20): Phosphorothioate or Phosphorodithioate 3'-Internucleotide Linkage (optionally present)
  misc_feature (3)..(3): 2'-O-methyl
  misc_feature (4)..(5): 2'-deoxy-2'Fluoro
  misc_feature (6)..(6): 2'-O-methyl
  misc_feature (7)..(7): 2'-deoxy-2'Fluoro
  misc_feature (8)..(11): 2'-O-methyl
  misc_feature (12)..(17): 2'-deoxy-2'Fluoro
  misc_feature (18)..(18): 2'-O-methyl
  misc_feature (19)..(19): 2'-deoxy-2'Fluoro
  misc_feature (1)..(19): ribonucleotide unmodified or modified as described for this sequence
guaccacaaggccuuucgctt

SEQ ID NO: 1989 - DNA, 21 bp, Artificial Sequence
  Description of Artificial Sequence: Target Sequence/siNA antisense region (stab25)
  misc_feature (20)..(20): Phosphorothioate or Phosphorodithioate 3'-Internucleotide Linkage (optionally present)
  misc_feature (4)..(4): 2'-O-methyl
  misc_feature (5)..(6): 2'-deoxy-2'Fluoro
  misc_feature (7)..(7): 2'-O-methyl
  misc_feature (8)..(8): 2'-deoxy-2'Fluoro
  misc_feature (9)..(12): 2'-O-methyl
  misc_feature (13)..(18): 2'-deoxy-2'Fluoro
  misc_feature (19)..(19): 2'-O-methyl
  misc_feature (1)..(19): ribonucleotide unmodified or modified as described for this sequence
aguaccacaaggccuuucgtt

SEQ ID NO: 1990 - DNA, 21 bp, Artificial Sequence
  Description of Artificial Sequence: Target Sequence/siNA antisense region (stab25)
  misc_feature (20)..(20): Phosphorothioate or Phosphorodithioate 3'-Internucleotide Linkage (optionally present)
  misc_feature (3)..(3): 2'-O-methyl
  misc_feature (4)..(6): 2'-deoxy-2'Fluoro
  misc_feature (7)..(7): 2'-O-methyl
  misc_feature (8)..(8): 2'-deoxy-2'Fluoro
  misc_feature (9)..(11): 2'-O-methyl
  misc_feature (12)..(12): 2'-deoxy-2'Fluoro
  misc_feature (13)..(13): 2'-O-methyl
  misc_feature (14)..(17): 2'-deoxy-2'Fluoro
  misc_feature (18)..(18): 2'-O-methyl
  misc_feature (19)..(19): 2'-deoxy-2'Fluoro
  misc_feature (1)..(19): ribonucleotide unmodified or modified as described for this sequence
gcacucgcaagcacccuautt

SEQ ID NO: 1991 - DNA, 21 bp, Artificial Sequence
  Description of Artificial Sequence: Target Sequence/siNA antisense region (stab26)
  misc_feature (4)..(4): 2'-O-methyl
  misc_feature (5)..(5): 2'-deoxy-2'Fluoro
  misc_feature (6)..(8): 2'-O-methyl
  misc_feature (9)..(9): 2'-deoxy-2'Fluoro
  misc_feature (10)..(10): 2'-O-methyl
  misc_feature (11)..(14): 2'-deoxy-2'Fluoro
  misc_feature (15)..(15): 2'-O-methyl
  misc_feature (16)..(17): 2'-deoxy-2'Fluoro
  misc_feature (18)..(19): 2'-O-methyl
  misc_feature (1)..(19): ribonucleotide unmodified or modified as described for this sequence
cucgcaagcacccuaucagtt

SEQ ID NO: 1992 - DNA, 21 bp, Artificial Sequence
  Description of Artificial Sequence: Target Sequence/siNA antisense region (stab27)
  misc_feature (21)..(21): 3'-3 attached terminal deoxyabasic moiety, inverted abasic, inverted nucleotide or other terminal cap that is optionally present
  misc_feature (4)..(4): 2'-O-methyl
  misc_feature (5)..(5): 2'-deoxy-2'Fluoro
  misc_feature (6)..(8): 2'-O-methyl
  misc_feature (9)..(9): 2'-deoxy-2'Fluoro
  misc_feature (10)..(10): 2'-O-methyl
  misc_feature (11)..(14): 2'-deoxy-2'Fluoro
  misc_feature (15)..(15): 2'-O-methyl
  misc_feature (16)..(17): 2'-deoxy-2'Fluoro
  misc_feature (18)..(19): 2'-O-methyl
  misc_feature (1)..(19): ribonucleotide unmodified or modified as described for this sequence
cucgcaagcacccuaucagtt

SEQ ID NO: 1993 - DNA, 21 bp, Artificial Sequence
  Description of Artificial Sequence: Target Sequence/siNA antisense region (stab19)
  misc_feature (21)..(21): 3'-3 attached terminal deoxyabasic moiety, inverted abasic, inverted nucleotide or other terminal cap that is optionally present
  misc_feature (2)..(2): 2'-deoxy-2'Fluoro
  misc_feature (3)..(3): 2'-O-methyl
  misc_feature (4)..(5): 2'-deoxy-2'Fluoro
  misc_feature (6)..(6): 2'-O-methyl
  misc_feature (7)..(7): 2'-deoxy-2'Fluoro
  misc_feature (8)..(11): 2'-O-methyl
  misc_feature (12)..(17): 2'-deoxy-2'Fluoro
  misc_feature (18)..(18): 2'-O-methyl
  misc_feature (19)..(19): 2'-deoxy-2'Fluoro
  misc_feature (1)..(19): ribonucleotide unmodified or modified as described for this sequence
guaccacaaggccuuucgctt

SEQ ID NO: 1994 - DNA, 21 bp, Artificial Sequence
  Description of Artificial Sequence: Target Sequence/siNA antisense region (stab26)
  misc_feature (3)..(3): 2'-O-methyl
  misc_feature (4)..(5): 2'-deoxy-2'Fluoro
  misc_feature (6)..(6): 2'-O-methyl
  misc_feature (7)..(7): 2'-deoxy-2'Fluoro
  misc_feature (8)..(11): 2'-O-methyl
  misc_feature (12)..(17): 2'-deoxy-2'Fluoro
  misc_feature (18)..(18): 2'-O-methyl
  misc_feature (19)..(19): 2'-deoxy-2'Fluoro
  misc_feature (1)..(19): ribonucleotide unmodified or modified as described for this sequence
guaccacaaggccuuucgctt

SEQ ID NO: 1995 - DNA, 21 bp, Artificial Sequence
  Description of Artificial Sequence: Target Sequence/siNA antisense region (stab27)
  misc_feature (21)..(21): 3'-3 attached terminal deoxyabasic moiety, inverted abasic, inverted nucleotide or other terminal cap that is optionally present
  misc_feature (3)..(3): 2'-O-methyl
  misc_feature (4)..(5): 2'-deoxy-2'Fluoro
  misc_feature (6)..(6): 2'-O-methyl
  misc_feature (7)..(7): 2'-deoxy-2'Fluoro
  misc_feature (8)..(11): 2'-O-methyl
  misc_feature (12)..(17): 2'-deoxy-2'Fluoro
  misc_feature (18)..(18): 2'-O-methyl
  misc_feature (19)..(19): 2'-deoxy-2'Fluoro
  misc_feature (1)..(19): ribonucleotide unmodified or modified as described for this sequence
guaccacaaggccuuucgctt

SEQ ID NO: 1996 - DNA, 21 bp, Artificial Sequence
  Description of Artificial Sequence: Target Sequence/siNA antisense region (stab29)
  misc_feature (20)..(20): Phosphorothioate or Phosphorodithioate 3'-Internucleotide Linkage (optionally present)
  misc_feature (2)..(2): 2'-deoxy-2'Fluoro
  misc_feature (3)..(3): 2'-O-methyl
  misc_feature (4)..(5): 2'-deoxy-2'Fluoro
  misc_feature (6)..(6): 2'-O-methyl
  misc_feature (7)..(7): 2'-deoxy-2'Fluoro
  misc_feature (8)..(11): 2'-O-methyl
  misc_feature (12)..(17): 2'-deoxy-2'Fluoro
  misc_feature (18)..(18): 2'-O-methyl
  misc_feature (19)..(19): 2'-deoxy-2'Fluoro
  misc_feature (1)..(19): ribonucleotide unmodified or modified as described for this sequence
guaccacaaggccuuucgctt

SEQ ID NO: 1997 - DNA, 21 bp, Artificial Sequence
  Description of Artificial Sequence: Target Sequence/siNA antisense region (stab30)
  misc_feature (2)..(2): 2'-deoxy-2'Fluoro
  misc_feature (3)..(3): 2'-O-methyl
  misc_feature (4)..(5): 2'-deoxy-2'Fluoro
  misc_feature (6)..(6): 2'-O-methyl
  misc_feature (7)..(7): 2'-deoxy-2'Fluoro
  misc_feature (8)..(11): 2'-O-methyl
  misc_feature (12)..(17): 2'-deoxy-2'Fluoro
  misc_feature (18)..(18): 2'-O-methyl
  misc_feature (19)..(19): 2'-deoxy-2'Fluoro
  misc_feature (1)..(19): ribonucleotide unmodified or modified as described for this sequence
guaccacaaggccuuucgctt

SEQ ID NO: 1998 - DNA, 21 bp, Artificial Sequence
  Description of Artificial Sequence: Target Sequence/siNA antisense region (stab31)
  misc_feature (21)..(21): 3'-3 attached terminal deoxyabasic moiety, inverted abasic, inverted nucleotide or other terminal cap that is optionally present
  misc_feature (2)..(2): 2'-deoxy-2'Fluoro
  misc_feature (3)..(3): 2'-O-methyl
  misc_feature (4)..(5): 2'-deoxy-2'Fluoro
  misc_feature (6)..(6): 2'-O-methyl
  misc_feature (7)..(7): 2'-deoxy-2'Fluoro
  misc_feature (8)..(11): 2'-O-methyl
  misc_feature (12)..(17): 2'-deoxy-2'Fluoro
  misc_feature (18)..(18): 2'-O-methyl
  misc_feature (19)..(19): 2'-deoxy-2'Fluoro
  misc_feature (1)..(19): ribonucleotide unmodified or modified as described for this sequence
guaccacaaggccuuucgctt

SEQ ID NO: 1999 - DNA, 21 bp, Artificial Sequence
  Description of Artificial Sequence: Target Sequence/siNA antisense region (stab32)
  misc_feature (2)..(2): 2'-deoxy-2'Fluoro
  misc_feature (3)..(3): 2'-O-methyl
  misc_feature (4)..(5): 2'-deoxy-2'Fluoro
  misc_feature (6)..(6): 2'-O-methyl
  misc_feature (7)..(7): 2'-deoxy-2'Fluoro
  misc_feature (8)..(11): 2'-O-methyl
  misc_feature (12)..(17): 2'-deoxy-2'Fluoro
  misc_feature (18)..(18): 2'-O-methyl
  misc_feature (19)..(19): 2'-deoxy-2'Fluoro
  misc_feature (1)..(19): ribonucleotide unmodified or modified as described for this sequence
guaccacaaggccuuucgctt

SEQ ID NO: 2000 - DNA, 21 bp, Artificial Sequence
  Description of Artificial Sequence: Target Sequence/siNA antisense region (stab32)
  misc_feature (1)..(3): 2'-deoxy-2'Fluoro
  misc_feature (4)..(4): 2'-O-methyl
  misc_feature (5)..(5): 2'-deoxy-2'Fluoro
  misc_feature (6)..(8): 2'-O-methyl
  misc_feature (9)..(9): 2'-deoxy-2'Fluoro
  misc_feature (10)..(10): 2'-O-methyl
  misc_feature (11)..(14): 2'-deoxy-2'Fluoro
  misc_feature (15)..(15): 2'-O-methyl
  misc_feature (16)..(17): 2'-deoxy-2'Fluoro
  misc_feature (18)..(19): 2'-O-methyl
  misc_feature (1)..(19): ribonucleotide unmodified or modified as described for this sequence
cucgcaagcacccuaucagtt

SEQ ID NO: 2001 - DNA, 21 bp, Artificial Sequence
  Description of Artificial Sequence: Target Sequence/siNA antisense region (stab27)
  misc_feature (21)..(21): 3'-3 attached terminal deoxyabasic moiety, inverted abasic, inverted nucleotide or other terminal cap that is optionally present
  misc_feature (4)..(5): 2'-deoxy-2'Fluoro
  misc_feature (6)..(6): 2'-O-methyl
  misc_feature (7)..(7): 2'-deoxy-2'Fluoro
  misc_feature (8)..(11): 2'-O-methyl
  misc_feature (12)..(17): 2'-deoxy-2'Fluoro
  misc_feature (18)..(19): 2'-O-methyl
  misc_feature (1)..(19): ribonucleotide unmodified or modified as described for this sequence
ggucuacgagaccucccggtt

SEQ ID NO: 2002 - DNA, 21 bp, Artificial Sequence
  Description of Artificial Sequence: Target Sequence/siNA antisense region (stab30)
  misc_feature (3)..(5): 2'-deoxy-2'Fluoro
  misc_feature (6)..(6): 2'-O-methyl
  misc_feature (7)..(7): 2'-deoxy-2'Fluoro
  misc_feature (8)..(11): 2'-O-methyl
  misc_feature (12)..(17): 2'-deoxy-2'Fluoro
  misc_feature (18)..(19): 2'-O-methyl
  misc_feature (1)..(19): ribonucleotide unmodified or modified as described for this sequence
ggucuacgagaccucccggtt

SEQ ID NO: 2003 - DNA, 21 bp, Artificial Sequence
  Description of Artificial Sequence: Target Sequence/siNA antisense region (stab31)
  misc_feature (21)..(21): 3'-3 attached terminal deoxyabasic moiety, inverted abasic, inverted nucleotide or other terminal cap that is optionally present
  misc_feature (3)..(5): 2'-deoxy-2'Fluoro
  misc_feature (6)..(6): 2'-O-methyl
  misc_feature (7)..(7): 2'-deoxy-2'Fluoro
  misc_feature (8)..(11): 2'-O-methyl
  misc_feature (12)..(17): 2'-deoxy-2'Fluoro
  misc_feature (18)..(19): 2'-O-methyl
  misc_feature (1)..(19): ribonucleotide unmodified or modified as described for this sequence
ggucuacgagaccucccggtt

SEQ ID NO: 2004 - DNA, 21 bp, Artificial Sequence
  Description of Artificial Sequence: Target Sequence/siNA antisense region (stab32)
  misc_feature (3)..(5): 2'-deoxy-2'Fluoro
  misc_feature (6)..(6): 2'-O-methyl
  misc_feature (7)..(7): 2'-deoxy-2'Fluoro
  misc_feature (8)..(11): 2'-O-methyl
  misc_feature (12)..(17): 2'-deoxy-2'Fluoro
  misc_feature (18)..(19): 2'-O-methyl
  misc_feature (1)..(19): ribonucleotide unmodified or modified as described for this sequence
ggucuacgagaccucccggtt

SEQ ID NO: 2005 - DNA, 42 bp, Artificial Sequence
  Description of Artificial Sequence: Target Sequence/siNA sense region (stab00)
  misc_feature (21)..(21): hexethelyne glycol spacer
  misc_feature (1)..(40): ribonucleotide unmodified or modified as described for this sequence
ccgggaggucucguagaccttcugauagggugcuugcgagtt

SEQ ID NO: 2006 - DNA, 42 bp, Artificial Sequence
  Description of Artificial Sequence: Target Sequence/siNA sense region (stab00)
  misc_feature (21)..(21): hexethelyne glycol spacer
  misc_feature (1)..(40): ribonucleotide unmodified or modified as described for this sequence
cugauagggugcuugcgagttgcgaaaggccuugugguactt

SEQ ID NO: 2007 - DNA, 42 bp, Artificial Sequence; identical to SEQ ID NO: 2005
  Description of Artificial Sequence: Target Sequence/siNA sense region (stab07)
  misc_feature (1)..(1): 5'-3 attached terminal deoxyabasic moiety, inverted abasic, inverted nucleotide or other terminal cap that is optionally present
  misc_feature (42)..(42): 3'-3 attached terminal deoxyabasic moiety, inverted abasic, inverted nucleotide or other terminal cap that is optionally present
  misc_feature (1)..(2): 2'-deoxy-2'Fluoro
  misc_feature (3)..(8): 2'-deoxy
  misc_feature (9)..(12): 2'-deoxy-2'Fluoro
  misc_feature (13)..(13): 2'-deoxy
  misc_feature (14)..(14): 2'-deoxy-2'Fluoro
  misc_feature (15)..(17): 2'-deoxy
  misc_feature (18)..(19): 2'-deoxy-2'Fluoro
  misc_feature (21)..(21): hexethelyne glycol spacer
  misc_feature (22)..(23): 2'-deoxy-2'Fluoro
  misc_feature (24)..(25): 2'-deoxy
  misc_feature (26)..(26): 2'-deoxy-2'Fluoro
  misc_feature (27)..(30): 2'-deoxy
  misc_feature (31)..(31): 2'-deoxy-2'Fluoro
  misc_feature (32)..(32): 2'-deoxy
  misc_feature (33)..(35): 2'-deoxy-2'Fluoro
  misc_feature (36)..(36): 2'-deoxy
  misc_feature (37)..(37): 2'-deoxy-2'Fluoro
  misc_feature (38)..(40): 2'-deoxy
  misc_feature (1)..(40): ribonucleotide unmodified or modified as described for this sequence

SEQ ID NO: 2008 - DNA, 42 bp, Artificial Sequence; identical to SEQ ID NO: 1978
  Description of Artificial Sequence: Target Sequence/siNA sense region (stab07)
  misc_feature (1)..(1): 5'-3 attached terminal deoxyabasic moiety, inverted abasic, inverted nucleotide or other terminal cap that is optionally present
  misc_feature (42)..(42): 3'-3 attached terminal deoxyabasic moiety, inverted abasic, inverted nucleotide or other terminal cap that is optionally present
  misc_feature (1)..(2): 2'-deoxy-2'Fluoro
  misc_feature (3)..(8): 2'-deoxy
  misc_feature (9)..(12): 2'-deoxy-2'Fluoro
  misc_feature (13)..(13): 2'-deoxy
  misc_feature (14)..(14): 2'-deoxy-2'Fluoro
  misc_feature (15)..(17): 2'-deoxy
  misc_feature (18)..(19): 2'-deoxy-2'Fluoro
  misc_feature (21)..(21): hexethelyne glycol spacer
  misc_feature (22)..(22): 2'-deoxy
  misc_feature (23)..(23): 2'-deoxy-2'Fluoro
  misc_feature (24)..(29): 2'-deoxy
  misc_feature (30)..(33): 2'-deoxy-2'Fluoro
  misc_feature (34)..(34): 2'-deoxy
  misc_feature (35)..(35): 2'-deoxy-2'Fluoro
  misc_feature (36)..(37): 2'-deoxy
  misc_feature (38)..(38): 2'-deoxy-2'Fluoro
  misc_feature (39)..(39): 2'-deoxy
  misc_feature (40)..(40): 2'-deoxy-2'Fluoro
  misc_feature (1)..(40): ribonucleotide unmodified or modified as described for this sequence

SEQ ID NO: 2009 - DNA, 42 bp, Artificial Sequence; identical to SEQ ID NO: 2006
  Description of Artificial Sequence: Target Sequence/siNA sense region (stab07)
  misc_feature (1)..(1): 5'-3 attached terminal deoxyabasic moiety, inverted abasic, inverted nucleotide or other terminal cap that is optionally present
  misc_feature (42)..(42): 3'-3 attached terminal deoxyabasic moiety, inverted abasic, inverted nucleotide or other terminal cap that is optionally present
  misc_feature (1)..(2): 2'-deoxy-2'Fluoro
  misc_feature (3)..(4): 2'-deoxy
  misc_feature (5)..(5): 2'-deoxy-2'Fluoro
  misc_feature (6)..(9): 2'-deoxy
  misc_feature (10)..(10): 2'-deoxy-2'Fluoro
  misc_feature (11)..(11): 2'-deoxy
  misc_feature (12)..(14): 2'-deoxy-2'Fluoro
  misc_feature (15)..(15): 2'-deoxy
  misc_feature (16)..(16): 2'-deoxy-2'Fluoro
  misc_feature (17)..(19): 2'-deoxy
  misc_feature (21)..(21): hexethelyne glycol spacer
  misc_feature (22)..(22): 2'-deoxy
  misc_feature (23)..(23): 2'-deoxy-2'Fluoro
  misc_feature (24)..(29): 2'-deoxy
  misc_feature (30)..(33): 2'-deoxy-2'Fluoro
  misc_feature (34)..(34): 2'-deoxy
  misc_feature (35)..(35): 2'-deoxy-2'Fluoro
  misc_feature (36)..(37): 2'-deoxy
  misc_feature (38)..(38): 2'-deoxy-2'Fluoro
  misc_feature (39)..(39): 2'-deoxy
  misc_feature (40)..(40): 2'-deoxy-2'Fluoro
  misc_feature (1)..(40): ribonucleotide unmodified or modified as described for this sequence

SEQ ID NO: 2010 - RNA, 21 nt, Artificial Sequence
  Description of Artificial Sequence: Target Sequence/siNA antisense region (stab26)
  misc_feature (4)..(4): 2'-O-methyl
  misc_feature (5)..(5): 2'-deoxy-2'Fluoro
  misc_feature (6)..(8): 2'-O-methyl
  misc_feature (9)..(9): 2'-deoxy-2'Fluoro
  misc_feature (10)..(10): 2'-O-methyl
  misc_feature (11)..(14): 2'-deoxy-2'Fluoro
  misc_feature (15)..(15): 2'-O-methyl
  misc_feature (16)..(17): 2'-deoxy-2'Fluoro
  misc_feature (18)..(21): 2'-O-methyl
  misc_feature (1)..(21): ribonucleotide unmodified or modified as described for this sequence
cucgcaagcacccuaucaguu

SEQ ID NO: 2011 - RNA, 21 nt, Artificial Sequence
  Description of Artificial Sequence: Target Sequence/siNA antisense region (stab26)
  misc_feature (4)..(5): 2'-deoxy-2'Fluoro
  misc_feature (6)..(6): 2'-O-methyl
  misc_feature (7)..(7): 2'-deoxy-2'Fluoro
  misc_feature (8)..(11): 2'-O-methyl
  misc_feature (12)..(17): 2'-deoxy-2'Fluoro
  misc_feature (18)..(21): 2'-O-methyl
  misc_feature (1)..(21): ribonucleotide unmodified or modified as described for this sequence
ggucuacgagaccucccgguu

SEQ ID NO: 2012 - RNA, 21 nt, Artificial Sequence
  Description of Artificial Sequence: Target Sequence/siNA antisense region (stab26)
  misc_feature (4)..(4): 2'-O-methyl
  misc_feature (5)..(5): 2'-deoxy-2'Fluoro
  misc_feature (6)..(8): 2'-O-methyl
  misc_feature (9)..(9): 2'-deoxy-2'Fluoro
  misc_feature (10)..(10): 2'-O-methyl
  misc_feature (11)..(14): 2'-deoxy-2'Fluoro
  misc_feature (15)..(15): 2'-O-methyl
  misc_feature (16)..(17): 2'-deoxy-2'Fluoro
  misc_feature (18)..(21): 2'-O-methyl
  misc_feature (1)..(21): ribonucleotide unmodified or modified as described for this sequence
cucgcaagcacccuaucaggc

SEQ ID NO: 2013 - RNA, 21 nt, Artificial Sequence
  Description of Artificial Sequence: Target Sequence/siNA antisense region (stab26)
  misc_feature (4)..(5): 2'-deoxy-2'Fluoro
  misc_feature (6)..(6): 2'-O-methyl
  misc_feature (7)..(7): 2'-deoxy-2'Fluoro
  misc_feature (8)..(11): 2'-O-methyl
  misc_feature (12)..(17): 2'-deoxy-2'Fluoro
  misc_feature (18)..(21): 2'-O-methyl
  misc_feature (1)..(21): ribonucleotide unmodified or modified as described for this sequence
ggucuacgagaccucccgggc

SEQ ID NO: 2014 - RNA, 19 nt, Artificial Sequence
  Description of Artificial Sequence: Target Sequence/siNA sense region
cugauagggcgcuugcgag

SEQ ID NO: 2015 - RNA, 18 nt, Artificial Sequence
  Description of Artificial Sequence: Target Sequence/siNA sense region
ugauagggugcuugcgag

SEQ ID NO: 2016 - RNA, 19 nt, Artificial Sequence
  Description of Artificial Sequence: Target Sequence/siNA sense region
aacugauagggugcuugcg

SEQ ID NO: 2017 - RNA, 23 nt, Artificial Sequence
  Description of Artificial Sequence: Target Sequence/siNA sense region
gucuucacgcagaaagcgucuag

SEQ ID NO: 2018 - RNA, 23 nt, Artificial Sequence
  Description of Artificial Sequence: Target Sequence/siNA sense region
aagcgucuagccauggcguuagu

SEQ ID NO: 2019 - RNA, 23 nt, Artificial Sequence
  Description of Artificial Sequence: Target Sequence/siNA sense region
gugaguacaccggaauugccagg

SEQ ID NO: 2020 - RNA, 23 nt, Artificial Sequence
  Description of Artificial Sequence: Target Sequence/siNA sense region
acgaccggguccuuucuuggauc

SEQ ID NO: 2021 - RNA, 23 nt, Artificial Sequence
  Description of Artificial Sequence: Target Sequence/siNA sense region
cccgcucaaugccuggagauuug

SEQ ID NO: 2022 - RNA, 23 nt, Artificial Sequence
  Description of Artificial Sequence: Target Sequence/siNA sense region
ccccgcgagacugcuagccgagu

SEQ ID NO: 2023 - RNA, 23 nt, Artificial Sequence
  Description of Artificial Sequence: Target Sequence/siNA sense region
ccgcgagacugcuagccgaguag

SEQ ID NO: 2024 - RNA, 23 nt, Artificial Sequence
  Description of Artificial Sequence: Target Sequence/siNA sense region
ccgaguaguguugggucgcgaaa

SEQ ID NO: 2025 - RNA, 23 nt, Artificial Sequence
  Description of Artificial Sequence: Target Sequence/siNA sense region
guguugggucgcgaaaggccuug

SEQ ID NO: 2026 - RNA, 23 nt, Artificial Sequence
  Description of Artificial Sequence: Target Sequence/siNA sense region
uugggucgcgaaaggccuugugg

SEQ ID NO: 2027 - RNA, 19 nt, Artificial Sequence
  Description of Artificial Sequence: Target Sequence/siNA sense region
gaaaggauuuggcuacaaa

SEQ ID NO: 2028 - RNA, 19 nt, Artificial Sequence
  Description of Artificial Sequence: Target Sequence/siNA sense region
aaggauuuggcuacaaaaa

SEQ ID NO: 2029 - RNA, 19 nt, Artificial Sequence
  Description of Artificial Sequence: Target Sequence/siNA sense region
aaggacuucaugauccagg

SEQ ID NO: 2030 - RNA, 19 nt, Artificial Sequence
  Description of Artificial Sequence: Target Sequence/siNA sense region
gagagcaccaagacagaca

SEQ ID NO: 2031 - RNA, 19 nt, Artificial Sequence
  Description of Artificial Sequence: Target Sequence/siNA sense region
aaagacuguuccaaaaaca

SEQ ID NO: 2032 - RNA, 19 nt, Artificial Sequence
  Description of Artificial Sequence: Target Sequence/siNA sense region
agauggcacaggaggaaag

SEQ ID NO: 2033 - RNA, 19 nt, Artificial Sequence
  Description of Artificial Sequence: Target Sequence/siNA sense region
cugauagggugcuugcgag

SEQ ID NO: 2034 - DNA, 21 bp, Artificial Sequence
  Description of Artificial Sequence: Target Sequence/siNA sense region (stab07)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(2): 2'-deoxy-2'Fluoro
  misc_feature (3)..(4): 2'-deoxy
  misc_feature (5)..(5): 2'-deoxy-2'Fluoro
  misc_feature (6)..(9): 2'-deoxy
  misc_feature (10)..(10): 2'-deoxy-2'Fluoro
  misc_feature (11)..(11): 2'-deoxy
  misc_feature (12)..(14): 2'-deoxy-2'Fluoro
  misc_feature (15)..(15): 2'-deoxy
  misc_feature (16)..(16): 2'-deoxy-2'Fluoro
  misc_feature (17)..(19): 2'-deoxy
  misc_feature (1)..(19): ribonucleotide unmodified or modified as described for this sequence
cugauagggcgcuugcgagtt

SEQ ID NO: 2035 - DNA, 21 bp, Artificial Sequence
  Description of Artificial Sequence: Target Sequence/siNA antisense region (stab25)
  misc_feature (20)..(20): Phosphorothioate or Phosphorodithioate 3'-Internucleotide Linkage (optionally present)
  misc_feature (4)..(4): 2'-O-methyl
  misc_feature (5)..(5): 2'-deoxy-2'Fluoro
  misc_feature (6)..(8): 2'-O-methyl
  misc_feature (9)..(9): 2'-deoxy-2'Fluoro
  misc_feature (10)..(10): 2'-O-methyl
  misc_feature (11)..(14): 2'-deoxy-2'Fluoro
  misc_feature (15)..(15): 2'-O-methyl
  misc_feature (16)..(17): 2'-deoxy-2'Fluoro
  misc_feature (18)..(19): 2'-O-methyl
  misc_feature (1)..(19): ribonucleotide unmodified or modified as described for this sequence
cucgcaagcgcccuaucagtt

SEQ ID NO: 2036 - DNA, 21 bp, Artificial Sequence
  Description of Artificial Sequence: Target Sequence/siNA sense region (stab07)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(2): 2'-deoxy-2'Fluoro
  misc_feature (3)..(4): 2'-deoxy
  misc_feature (5)..(5): 2'-deoxy-2'Fluoro
  misc_feature (6)..(6): 2'-deoxy
  misc_feature (7)..(9): 2'-deoxy-2'Fluoro
  misc_feature (10)..(10): 2'-deoxy
  misc_feature (11)..(11): 2'-deoxy-2'Fluoro
  misc_feature (12)..(13): 2'-deoxy
  misc_feature (14)..(14): 2'-deoxy-2'Fluoro
  misc_feature (15)..(15): 2'-deoxy
  misc_feature (16)..(16): 2'-deoxy-2'Fluoro
  misc_feature (17)..(19): 2'-deoxy
  misc_feature (1)..(19): ribonucleotide unmodified or modified as described for this sequence
cugauacccacgaugcgagtt

SEQ ID NO: 2037 - DNA, 21 bp, Artificial Sequence
  Description of Artificial Sequence: Target Sequence/siNA sense region (stab07)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(2): 2'-deoxy-2'Fluoro
  misc_feature (3)..(6): 2'-deoxy
  misc_feature (7)..(8): 2'-deoxy-2'Fluoro
  misc_feature (9)..(12): 2'-deoxy
  misc_feature (13)..(14): 2'-deoxy-2'Fluoro
  misc_feature (15)..(17): 2'-deoxy
  misc_feature (18)..(19): 2'-deoxy-2'Fluoro
  misc_feature (1)..(19): ribonucleotide unmodified or modified as described for this sequence
ccgggaccagagcuagacctt

SEQ ID NO: 2038 - DNA, 21 bp, Artificial Sequence
  Description of Artificial Sequence: Target Sequence/siNA sense region (stab07)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(1): 2'-deoxy
  misc_feature (2)..(2): 2'-deoxy-2'Fluoro
  misc_feature (3)..(6): 2'-deoxy
  misc_feature (7)..(8): 2'-deoxy-2'Fluoro
  misc_feature (9)..(12): 2'-deoxy
  misc_feature (13)..(14): 2'-deoxy-2'Fluoro
  misc_feature (15)..(16): 2'-deoxy
  misc_feature (17)..(17): 2'-deoxy-2'Fluoro
  misc_feature (18)..(18): 2'-deoxy
  misc_feature (19)..(19): 2'-deoxy-2'Fluoro
  misc_feature (1)..(19): ribonucleotide unmodified or modified as described for this sequence
gcgaaaccggaacugguactt

SEQ ID NO: 2039 - DNA, 21 bp, Artificial Sequence
  Description of Artificial Sequence: Target Sequence/siNA antisense region (stab25)
  misc_feature (20)..(20): Phosphorothioate or Phosphorodithioate 3'-Internucleotide Linkage (optionally present)
  misc_feature (4)..(4): 2'-deoxy
  misc_feature (5)..(5): 2'-deoxy-2'Fluoro
  misc_feature (6)..(6): 2'-deoxy
  misc_feature (7)..(8): 2'-deoxy-2'Fluoro
  misc_feature (9)..(9): 2'-deoxy
  misc_feature (10)..(10): 2'-deoxy-2'Fluoro
  misc_feature (11)..(13): 2'-deoxy
  misc_feature (14)..(14): 2'-deoxy-2'Fluoro
  misc_feature (15)..(15): 2'-deoxy
  misc_feature (16)..(17): 2'-deoxy-2'Fluoro
  misc_feature (18)..(19): 2'-deoxy
  misc_feature (1)..(19): ribonucleotide unmodified or modified as described for this sequence
cucgcaucguggguaucagtt

SEQ ID NO: 2040 - DNA, 21 bp, Artificial Sequence
  Description of Artificial Sequence: Target Sequence/siNA antisense region (stab25)
  misc_feature (20)..(20): Phosphorothioate or Phosphorodithioate 3'-Internucleotide Linkage (optionally present)
  misc_feature (4)..(5): 2'-deoxy-2'Fluoro
  misc_feature (6)..(7): 2'-deoxy
  misc_feature (8)..(11): 2'-deoxy-2'Fluoro
  misc_feature (12)..(13): 2'-deoxy
  misc_feature (14)..(17): 2'-deoxy-2'Fluoro
  misc_feature (18)..(19): 2'-deoxy
  misc_feature (1)..(19): ribonucleotide unmodified or modified as described for this sequence
ggucuagcucuggucccggtt

SEQ ID NO: 2041 - DNA, 21 bp, Artificial Sequence
  Description of Artificial Sequence: Target Sequence/siNA antisense region (stab25)
  misc_feature (20)..(20): Phosphorothioate or Phosphorodithioate 3'-Internucleotide Linkage (optionally present)
  misc_feature (4)..(5): 2'-deoxy-2'Fluoro
  misc_feature (6)..(7): 2'-deoxy
  misc_feature (8)..(11): 2'-deoxy-2'Fluoro
  misc_feature (12)..(13): 2'-deoxy
  misc_feature (14)..(17): 2'-deoxy-2'Fluoro
  misc_feature (18)..(18): 2'-deoxy
  misc_feature (19)..(19): 2'-deoxy-2'Fluoro
  misc_feature (1)..(19): ribonucleotide unmodified or modified as described for this sequence
guaccaguuccgguuucgctt

SEQ ID NO: 2042 - DNA, 21 bp, Artificial Sequence
  Description of Artificial Sequence: Target Sequence/siNA antisense region (stab29)
  misc_feature (20)..(20): Phosphorothioate or Phosphorodithioate 3'-Internucleotide Linkage (optionally present)
  misc_feature (3)..(5): 2'-deoxy-2'Fluoro
  misc_feature (6)..(7): 2'-O-methyl
  misc_feature (8)..(11): 2'-deoxy-2'Fluoro
  misc_feature (12)..(13): 2'-O-methyl
  misc_feature (14)..(17): 2'-deoxy-2'Fluoro
  misc_feature (18)..(19): 2'-O-methyl
  misc_feature (1)..(19): ribonucleotide unmodified or modified as described for this sequence
ggucuagcucuggucccggtt

SEQ ID NO: 2043 - DNA, 21 bp, Artificial Sequence
  Description of Artificial Sequence: Target Sequence/siNA sense region (stab29)
  misc_feature (20)..(20): Phosphorothioate or Phosphorodithioate 3'-Internucleotide Linkage (optionally present)
  misc_feature (2)..(2): 2'-deoxy-2'Fluoro
  misc_feature (4)..(5): 2'-deoxy-2'Fluoro
  misc_feature (6)..(7): 2'-O-methyl
  misc_feature (8)..(11): 2'-deoxy-2'Fluoro
  misc_feature (12)..(13): 2'-O-methyl
  misc_feature (14)..(17): 2'-deoxy-2'Fluoro
  misc_feature (18)..(18): 2'-O-methyl
  misc_feature (19)..(19): 2'-deoxy-2'Fluoro
  misc_feature (1)..(19): ribonucleotide unmodified or modified as described for this sequence
guaccaguuccgguuucgctt

SEQ ID NO: 2044 - DNA, 21 bp, Artificial Sequence
  Description of Artificial Sequence: Target Sequence/siNA antisense region (stab08)
  misc_feature (20)..(20): Phosphorothioate or Phosphorodithioate 3'-Internucleotide Linkage (optionally present)
  misc_feature (1)..(3): 2'-deoxy-2'Fluoro
  misc_feature (4)..(4): 2'-O-methyl
  misc_feature (5)..(5): 2'-deoxy-2'Fluoro
  misc_feature (6)..(6): 2'-O-methyl
  misc_feature (7)..(8): 2'-deoxy-2'Fluoro
  misc_feature (9)..(9): 2'-O-methyl
  misc_feature (10)..(10): 2'-deoxy-2'Fluoro
  misc_feature (11)..(13): 2'-O-methyl
  misc_feature (14)..(14): 2'-deoxy-2'Fluoro
  misc_feature (15)..(15): 2'-O-methyl
  misc_feature (16)..(17): 2'-deoxy-2'Fluoro
  misc_feature (18)..(19): 2'-O-methyl
  misc_feature (1)..(19): ribonucleotide unmodified or modified as described for this sequence
cucgcaucguggguaucagtt

SEQ ID NO: 2045 - DNA, 21 bp, Artificial Sequence
  Description of Artificial Sequence: Target Sequence/siNA antisense region (stab25)
  misc_feature (20)..(20): Phosphorothioate or Phosphorodithioate 3'-Internucleotide Linkage (optionally present)
  misc_feature (4)..(4): 2'-deoxy-2'Fluoro
  misc_feature (5)..(5): 2'-O-methyl
  misc_feature (6)..(9): 2'-deoxy-2'Fluoro
  misc_feature (10)..(10): 2'-O-methyl
  misc_feature (11)..(11): 2'-deoxy-2'Fluoro
  misc_feature (12)..(14): 2'-O-methyl
  misc_feature (15)..(15): 2'-deoxy-2'Fluoro
  misc_feature (16)..(16): 2'-O-methyl
  misc_feature (17)..(19): 2'-deoxy-2'Fluoro
  misc_feature (1)..(19): ribonucleotide unmodified or modified as described for this sequence
gacuaucccacgaacgcuctt

SEQ ID NO: 2046 - DNA, 21 bp, Artificial Sequence
  Description of Artificial Sequence: Target Sequence/siNA antisense region (stab25A)
  misc_feature (20)..(20): Phosphorothioate or Phosphorodithioate 3'-Internucleotide Linkage (optionally present)
  misc_feature (3)..(4): 2'-deoxy-2'Fluoro
  misc_feature (5)..(5): 2'-O-methyl
  misc_feature (6)..(9): 2'-deoxy-2'Fluoro
  misc_feature (10)..(10): 2'-O-methyl
  misc_feature (11)..(11): 2'-deoxy-2'Fluoro
  misc_feature (12)..(14): 2'-O-methyl
  misc_feature (15)..(15): 2'-deoxy-2'Fluoro
  misc_feature (16)..(16): 2'-O-methyl
  misc_feature (1)..(19): ribonucleotide unmodified or modified as described for this sequence
gacuaucccacgaacgcuctt

SEQ ID NO: 2047 - DNA, 21 bp, Artificial Sequence
  Description of Artificial Sequence: Target Sequence/siNA sense region (stab07)
  misc_feature (1)..(1): 5'-3 attached terminal deoxyabasic moiety, inverted abasic, inverted nucleotide or other terminal cap that is optionally present
  misc_feature (1)..(2): 2'-deoxy-2'Fluoro
  misc_feature (3)..(4): 2'-deoxy
  misc_feature (5)..(5): 2'-deoxy-2'Fluoro
  misc_feature (6)..(9): 2'-deoxy
  misc_feature (10)..(10): 2'-deoxy-2'Fluoro
  misc_feature (11)..(11): 2'-deoxy
  misc_feature (12)..(14): 2'-deoxy-2'Fluoro
  misc_feature (15)..(15): 2'-deoxy
  misc_feature (16)..(16): 2'-deoxy-2'Fluoro
  misc_feature (17)..(19): 2'-deoxy
  misc_feature (1)..(19): ribonucleotide unmodified or modified as described for this sequence
cugauagggugcuugcgagtt

SEQ ID NO: 2048 - DNA, 20 bp, Artificial Sequence
  Description of Artificial Sequence: Target Sequence/siNA sense region (stab07)
  misc_feature (1)..(1): 5'-3 attached terminal deoxyabasic moiety, inverted abasic, inverted nucleotide or other terminal cap that is optionally present
  misc_feature (1)..(2): 2'-deoxy-2'Fluoro
  misc_feature (3)..(4): 2'-deoxy
  misc_feature (5)..(5): 2'-deoxy-2'Fluoro
  misc_feature (6)..(9): 2'-deoxy
  misc_feature (10)..(10): 2'-deoxy-2'Fluoro
  misc_feature (11)..(11): 2'-deoxy
  misc_feature (12)..(14): 2'-deoxy-2'Fluoro
  misc_feature (15)..(15): 2'-deoxy
  misc_feature (16)..(16): 2'-deoxy-2'Fluoro
  misc_feature (17)..(19): 2'-deoxy
  misc_feature (1)..(19): ribonucleotide unmodified or modified as described for this sequence
cugauagggugcuugcgagt

SEQ ID NO: 2049 - DNA, 21 bp, Artificial Sequence
  Description of Artificial Sequence: Target Sequence/siNA sense region (stab07)
  misc_feature (21)..(21): 3'-3 attached terminal deoxyabasic moiety, inverted abasic, inverted nucleotide or other terminal cap that is optionally present
  misc_feature (1)..(2): 2'-deoxy-2'Fluoro
  misc_feature (3)..(4): 2'-deoxy
  misc_feature (5)..(5): 2'-deoxy-2'Fluoro
  misc_feature (6)..(9): 2'-deoxy
  misc_feature (10)..(10): 2'-deoxy-2'Fluoro
  misc_feature (11)..(11): 2'-deoxy
  misc_feature (12)..(14): 2'-deoxy-2'Fluoro
  misc_feature (15)..(15): 2'-deoxy
  misc_feature (16)..(16): 2'-deoxy-2'Fluoro
  misc_feature (17)..(19): 2'-deoxy
  misc_feature (1)..(19): ribonucleotide unmodified or modified as described for this sequence
cugauagggugcuugcgagtt

SEQ ID NO: 2050 - DNA, 20 bp, Artificial Sequence
  Description of Artificial Sequence: Target Sequence/siNA sense region (stab07)
  misc_feature (20)..(20): 3'-3 attached terminal deoxyabasic moiety, inverted abasic, inverted nucleotide or other terminal cap that is optionally present
  misc_feature (1)..(1): 2'-deoxy-2'Fluoro
  misc_feature (2)..(3): 2'-deoxy
  misc_feature (4)..(4): 2'-deoxy-2'Fluoro
  misc_feature (5)..(8): 2'-deoxy
  misc_feature (9)..(9): 2'-deoxy-2'Fluoro
  misc_feature (10)..(10): 2'-deoxy
  misc_feature (11)..(13): 2'-deoxy-2'Fluoro
  misc_feature (14)..(14): 2'-deoxy
  misc_feature (15)..(15): 2'-deoxy-2'Fluoro
  misc_feature (16)..(18): 2'-deoxy
  misc_feature (1)..(18): ribonucleotide unmodified or modified as described for this sequence
ugauagggugcuugcgagtt

SEQ ID NO: 2051 - DNA, 19 bp, Artificial Sequence
  Description of Artificial Sequence: Target Sequence/siNA sense region (stab07)
  misc_feature (19)..(19): 3'-3 attached terminal deoxyabasic moiety, inverted abasic, inverted nucleotide or other terminal cap that is optionally present
  misc_feature (3)..(3): 2'-deoxy-2'Fluoro
  misc_feature (4)..(7): 2'-deoxy
  misc_feature (8)..(8): 2'-deoxy-2'Fluoro
  misc_feature (9)..(9): 2'-deoxy
  misc_feature (10)..(12): 2'-deoxy-2'Fluoro
  misc_feature (13)..(13): 2'-deoxy
  misc_feature (14)..(14): 2'-deoxy-2'Fluoro
  misc_feature (15)..(17): 2'-deoxy
  misc_feature (1)..(17): ribonucleotide unmodified or modified as described for this sequence
gauagggugcuugcgagtt

SEQ ID NO: 2052 - DNA, 20 bp, Artificial Sequence
  Description of Artificial Sequence: Target Sequence/siNA antisense region (stab08)
  misc_feature (1)..(3): 2'-deoxy-2'Fluoro
  misc_feature (4)..(4): 2'-O-methyl
  misc_feature (5)..(5): 2'-deoxy-2'Fluoro
  misc_feature (6)..(8): 2'-O-methyl
  misc_feature (9)..(9): 2'-deoxy-2'Fluoro
  misc_feature (10)..(10): 2'-O-methyl
  misc_feature (11)..(14): 2'-deoxy-2'Fluoro
  misc_feature (15)..(15): 2'-O-methyl
  misc_feature (16)..(17): 2'-deoxy-2'Fluoro
  misc_feature (18)..(19): 2'-O-methyl
  misc_feature (1)..(19): ribonucleotide unmodified or modified as described for this sequence
cucgcaagcacccuaucagt

SEQ ID NO: 2053 - DNA, 19 bp, Artificial Sequence
  Description of Artificial Sequence: Target Sequence/siNA antisense region (stab08)
  misc_feature (1)..(3): 2'-deoxy-2'Fluoro
  misc_feature (4)..(4): 2'-O-methyl
  misc_feature (5)..(5): 2'-deoxy-2'Fluoro
  misc_feature (6)..(8): 2'-O-methyl
  misc_feature (9)..(9): 2'-deoxy-2'Fluoro
  misc_feature (10)..(10): 2'-O-methyl
  misc_feature (11)..(14): 2'-deoxy-2'Fluoro
  misc_feature (15)..(15): 2'-O-methyl
  misc_feature (16)..(17): 2'-deoxy-2'Fluoro
  misc_feature (18)..(19): 2'-O-methyl
  misc_feature (1)..(19): ribonucleotide unmodified or modified as described for this sequence
cucgcaagcacccuaucag

SEQ ID NO: 2054 - DNA, 18 bp, Artificial Sequence
  Description of Artificial Sequence: Target Sequence/siNA antisense region (stab08)
  misc_feature (1)..(3): 2'-deoxy-2'Fluoro
  misc_feature (4)..(4): 2'-O-methyl
  misc_feature (5)..(5): 2'-deoxy-2'Fluoro
  misc_feature (6)..(8): 2'-O-methyl
  misc_feature (9)..(9): 2'-deoxy-2'Fluoro
  misc_feature (10)..(10): 2'-O-methyl
  misc_feature (11)..(14): 2'-deoxy-2'Fluoro
  misc_feature (15)..(15): 2'-O-methyl
  misc_feature (16)..(17): 2'-deoxy-2'Fluoro
  misc_feature (18)..(18): 2'-O-methyl
  misc_feature (1)..(18): ribonucleotide unmodified or modified as described for this sequence
cucgcaagcacccuauca

SEQ ID NO: 2055 - DNA, 20 bp, Artificial Sequence
  Description of Artificial Sequence: Target Sequence/siNA antisense region (stab08)
  misc_feature (19)..(19): Phosphorothioate or Phosphorodithioate 3'-Internucleotide Linkage (optionally present)
  misc_feature (1)..(2): 2'-deoxy-2'Fluoro
  misc_feature (3)..(3): 2'-O-methyl
  misc_feature (4)..(4): 2'-deoxy-2'Fluoro
  misc_feature (5)..(7): 2'-O-methyl
  misc_feature (8)..(8): 2'-deoxy-2'Fluoro
  misc_feature (9)..(9): 2'-O-methyl
  misc_feature (10)..(13): 2'-deoxy-2'Fluoro
  misc_feature (14)..(14): 2'-O-methyl
  misc_feature (15)..(16): 2'-deoxy-2'Fluoro
  misc_feature (17)..(18): 2'-O-methyl
  misc_feature (1)..(18): ribonucleotide unmodified or modified as described for this sequence
ucgcaagcacccuaucagtt

SEQ ID NO: 2056 - DNA, 19 bp, Artificial Sequence
  Description of Artificial Sequence: Target Sequence/siNA antisense region (stab08)
  misc_feature (18)..(18): Phosphorothioate or Phosphorodithioate 3'-Internucleotide Linkage (optionally present)
  misc_feature (1)..(1): 2'-deoxy-2'Fluoro
  misc_feature (2)..(2): 2'-O-methyl
  misc_feature (3)..(3): 2'-deoxy-2'Fluoro
  misc_feature (4)..(6): 2'-O-methyl
  misc_feature (7)..(7): 2'-deoxy-2'Fluoro
  misc_feature (8)..(8): 2'-O-methyl
  misc_feature (9)..(12): 2'-deoxy-2'Fluoro
  misc_feature (13)..(13): 2'-O-methyl
  misc_feature (14)..(15): 2'-deoxy-2'Fluoro
  misc_feature (16)..(17): 2'-O-methyl
  misc_feature (1)..(17): ribonucleotide unmodified or modified as described for this sequence
cgcaagcacccuaucagtt

SEQ ID NO: 2057 - DNA, 18 bp, Artificial Sequence
  Description of Artificial Sequence: Target Sequence/siNA antisense region (stab08)
  misc_feature (17)..(17): Phosphorothioate or Phosphorodithioate 3'-Internucleotide Linkage (optionally present)
  misc_feature (2)..(2): 2'-deoxy-2'Fluoro
  misc_feature (3)..(5): 2'-O-methyl
  misc_feature (6)..(6): 2'-deoxy-2'Fluoro
  misc_feature (7)..(7): 2'-O-methyl
  misc_feature (8)..(11): 2'-deoxy-2'Fluoro
  misc_feature (12)..(12): 2'-O-methyl
  misc_feature (13)..(14): 2'-deoxy-2'Fluoro
  misc_feature (15)..(16): 2'-O-methyl
  misc_feature (1)..(16): ribonucleotide unmodified or modified as described for this sequence
gcaagcacccuaucagtt

SEQ ID NO: 2058 - DNA, 20 bp, Artificial Sequence
  Description of Artificial Sequence: Target Sequence/siNA antisense region (stab25)
  misc_feature (4)..(4): 2'-O-methyl
  misc_feature (5)..(5): 2'-deoxy-2'Fluoro
  misc_feature (6)..(8): 2'-O-methyl
  misc_feature (9)..(9): 2'-deoxy-2'Fluoro
  misc_feature (10)..(10): 2'-O-methyl
  misc_feature (11)..(14): 2'-deoxy-2'Fluoro
  misc_feature (15)..(15): 2'-O-methyl
  misc_feature (16)..(17): 2'-deoxy-2'Fluoro
  misc_feature (18)..(19): 2'-O-methyl
  misc_feature (1)..(19): ribonucleotide unmodified or modified as described for this sequence
cucgcaagcacccuaucagt

SEQ ID NO: 2059 - DNA, 18 bp, Artificial Sequence
  Description of Artificial Sequence: Target Sequence/siNA antisense region (stab25)
  misc_feature (4)..(4): 2'-O-methyl
  misc_feature (5)..(5): 2'-deoxy-2'Fluoro
  misc_feature (6)..(8): 2'-O-methyl
  misc_feature (9)..(9): 2'-deoxy-2'Fluoro
  misc_feature (10)..(10): 2'-O-methyl
  misc_feature (11)..(14): 2'-deoxy-2'Fluoro
  misc_feature (15)..(15): 2'-O-methyl
  misc_feature (16)..(17): 2'-deoxy-2'Fluoro
  misc_feature (18)..(18): 2'-O-methyl
  misc_feature (1)..(18): ribonucleotide unmodified or modified as described for this sequence
cucgcaagcacccuauca

SEQ ID NO: 2060 - DNA, 20 bp, Artificial Sequence
  Description of Artificial Sequence: Target Sequence/siNA antisense region (stab25)
  misc_feature (19)..(19): Phosphorothioate or Phosphorodithioate 3'-Internucleotide Linkage (optionally present)
  misc_feature (3)..(3): 2'-O-methyl
  misc_feature (4)..(4): 2'-deoxy-2'Fluoro
  misc_feature (5)..(7): 2'-O-methyl
  misc_feature (8)..(8): 2'-deoxy-2'Fluoro
  misc_feature (9)..(9): 2'-O-methyl
  misc_feature (10)..(13): 2'-deoxy-2'Fluoro
  misc_feature (14)..(14): 2'-O-methyl
  misc_feature (15)..(16): 2'-deoxy-2'Fluoro
  misc_feature (17)..(18): 2'-O-methyl
  misc_feature (1)..(18): ribonucleotide unmodified or modified as described for this sequence
ucgcaagcacccuaucagtt

SEQ ID NO: 2061 - DNA, 19 bp, Artificial Sequence
  Description of Artificial Sequence: Target Sequence/siNA antisense region (stab25)
  misc_feature (18)..(18): Phosphorothioate or Phosphorodithioate 3'-Internucleotide Linkage (optionally present)
  misc_feature (2)..(2): 2'-O-methyl
  misc_feature (3)..(3): 2'-deoxy-2'Fluoro
  misc_feature (4)..(6): 2'-O-methyl
  misc_feature (7)..(7): 2'-deoxy-2'Fluoro
  misc_feature (8)..(8): 2'-O-methyl
  misc_feature (9)..(12): 2'-deoxy-2'Fluoro
  misc_feature (13)..(13): 2'-O-methyl
  misc_feature (14)..(15): 2'-deoxy-2'Fluoro
  misc_feature (16)..(17): 2'-O-methyl
  misc_feature (1)..(17): ribonucleotide unmodified or modified as described for this sequence
cgcaagcacccuaucagtt

SEQ ID NO: 2062 - DNA, 21 bp, Artificial Sequence
  Description of Artificial Sequence: Target Sequence/siNA sense region (stab07)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(4): 2'-deoxy-2'Fluoro
  misc_feature (5)..(5): 2'-deoxy
  misc_feature (6)..(6): 2'-deoxy-2'Fluoro
  misc_feature (7)..(7): 2'-deoxy
  misc_feature (8)..(8): 2'-deoxy-2'Fluoro
  misc_feature (9)..(14): 2'-deoxy
  misc_feature (15)..(15): 2'-deoxy-2'Fluoro
  misc_feature (16)..(16): 2'-deoxy
  misc_feature (17)..(19): 2'-deoxy-2'Fluoro
  misc_feature (1)..(19): ribonucleotide unmodified or modified as described for this sequence
cuucacgcagaaagcgucutt

SEQ ID NO: 2063 - DNA, 21 bp, Artificial Sequence
  Description of Artificial Sequence: Target Sequence/siNA sense region (stab07)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(1): 2'-deoxy
  misc_feature (2)..(2): 2'-deoxy-2'Fluoro
  misc_feature (3)..(3): 2'-deoxy
  misc_feature (4)..(6): 2'-deoxy-2'Fluoro
  misc_feature (7)..(8): 2'-deoxy
  misc_feature (9)..(10): 2'-deoxy-2'Fluoro
  misc_feature (11)..(11): 2'-deoxy
  misc_feature (12)..(12): 2'-deoxy-2'Fluoro
  misc_feature (13)..(14): 2'-deoxy
  misc_feature (15)..(15): 2'-deoxy-2'Fluoro
  misc_feature (16)..(16): 2'-deoxy
  misc_feature (17)..(18): 2'-deoxy-2'Fluoro
  misc_feature (19)..(19): 2'-deoxy
  misc_feature (1)..(19): ribonucleotide unmodified or modified as described for this sequence
gcgucuagccauggcguuatt

SEQ ID NO: 2064 - DNA, 21 bp, Artificial Sequence
  Description of Artificial Sequence: Target Sequence/siNA sense region (stab07)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(3): 2'-deoxy
  misc_feature (4)..(4): 2'-deoxy-2'Fluoro
  misc_feature (5)..(5): 2'-deoxy
  misc_feature (6)..(6): 2'-deoxy-2'Fluoro
  misc_feature (7)..(7): 2'-deoxy
  misc_feature (8)..(9): 2'-deoxy-2'Fluoro
  misc_feature (10)..(13): 2'-deoxy
  misc_feature (14)..(15): 2'-deoxy-2'Fluoro
  misc_feature (16)..(16): 2'-deoxy
  misc_feature (17)..(18): 2'-deoxy-2'Fluoro
  misc_feature (19)..(19): 2'-deoxy
  misc_feature (1)..(19): ribonucleotide unmodified or modified as described for this sequence
gaguacaccggaauugccatt

SEQ ID NO: 2065 - DNA, 21 bp, Artificial Sequence
  Description of Artificial Sequence: Target Sequence/siNA sense region (stab07)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(2): 2'-deoxy
  misc_feature (3)..(4): 2'-deoxy-2'Fluoro
  misc_feature (5)..(7): 2'-deoxy
  misc_feature (8)..(16): 2'-deoxy-2'Fluoro
  misc_feature (17)..(19): 2'-deoxy
  misc_feature (1)..(19): ribonucleotide unmodified or modified as described for this sequence
gaccggguccuuucuuggatt

SEQ ID NO: 2066 - DNA, 21 bp, Artificial Sequence
  Description of Artificial Sequence: Target Sequence/siNA sense region (stab07)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(1): 2'-deoxy-2'Fluoro
  misc_feature (2)..(2): 2'-deoxy
  misc_feature (3)..(5): 2'-deoxy-2'Fluoro
  misc_feature (6)..(7): 2'-deoxy
  misc_feature (8)..(8): 2'-deoxy-2'Fluoro
  misc_feature (9)..(9): 2'-deoxy
  misc_feature (10)..(12): 2'-deoxy-2'Fluoro
  misc_feature (13)..(17): 2'-deoxy
  misc_feature (18)..(19): 2'-deoxy-2'Fluoro
  misc_feature (1)..(19): ribonucleotide unmodified or modified as described for this sequence
cgcucaaugccuggagauutt

SEQ ID NO: 2067 - DNA, 21 bp, Artificial Sequence
  Description of Artificial Sequence: Target Sequence/siNA sense region (stab07)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(2): 2'-deoxy-2'Fluoro
  misc_feature (3)..(3): 2'-deoxy
  misc_feature (4)..(4): 2'-deoxy-2'Fluoro
  misc_feature (5)..(8): 2'-deoxy
  misc_feature (9)..(10): 2'-deoxy-2'Fluoro
  misc_feature (11)..(11): 2'-deoxy
  misc_feature (12)..(13): 2'-deoxy-2'Fluoro
  misc_feature (14)..(15): 2'-deoxy
  misc_feature (16)..(17): 2'-deoxy-2'Fluoro
  misc_feature (18)..(19): 2'-deoxy
  misc_feature (1)..(19): ribonucleotide unmodified or modified as described for this sequence
ccgcgagacugcuagccgatt

SEQ ID NO: 2068 - DNA, 21 bp, Artificial Sequence
  Description of Artificial Sequence: Target Sequence/siNA sense region (stab07)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(1): 2'-deoxy
  misc_feature (2)..(2): 2'-deoxy-2'Fluoro
  misc_feature (3)..(6): 2'-deoxy
  misc_feature (7)..(8): 2'-deoxy-2'Fluoro
  misc_feature (9)..(9): 2'-deoxy
  misc_feature (10)..(11): 2'-deoxy-2'Fluoro
  misc_feature (12)..(13): 2'-deoxy
  misc_feature (14)..(15): 2'-deoxy-2'Fluoro
  misc_feature (16)..(18): 2'-deoxy
  misc_feature (19)..(19): 2'-deoxy-2'Fluoro
  misc_feature (1)..(19): ribonucleotide unmodified or modified as described for this sequence
gcgagacugcuagccgagutt

SEQ ID NO: 2069 - DNA, 21 bp, Artificial Sequence
  Description of Artificial Sequence: Target Sequence/siNA sense region (stab07)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(3): 2'-deoxy
  misc_feature (4)..(4): 2'-deoxy-2'Fluoro
  misc_feature (5)..(6): 2'-deoxy
  misc_feature (7)..(7): 2'-deoxy-2'Fluoro
  misc_feature (8)..(8): 2'-deoxy
  misc_feature (9)..(10): 2'-deoxy-2'Fluoro
  misc_feature (11)..(13): 2'-deoxy
  misc_feature (14)..(15): 2'-deoxy-2'Fluoro
  misc_feature (16)..(16): 2'-deoxy
  misc_feature (17)..(17): 2'-deoxy-2'Fluoro
  misc_feature (18)..(19): 2'-deoxy
  misc_feature (1)..(19): ribonucleotide unmodified or modified as described for this sequence
gaguaguguugggucgcgatt

SEQ ID NO: 2070 - DNA, 21 bp, Artificial Sequence
  Description of Artificial Sequence: Target Sequence/siNA sense region (stab07)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(1): 2'-deoxy
  misc_feature (2)..(3): 2'-deoxy-2'Fluoro
  misc_feature (4)..(6): 2'-deoxy
  misc_feature (7)..(8): 2'-deoxy-2'Fluoro
  misc_feature (9)..(9): 2'-deoxy
  misc_feature (10)..(10): 2'-deoxy-2'Fluoro
  misc_feature (11)..(16): 2'-deoxy
  misc_feature (17)..(19): 2'-deoxy-2'Fluoro
  misc_feature (1)..(19): ribonucleotide unmodified or modified as described for this sequence
guugggucgcgaaaggccutt

SEQ ID NO: 2071 - DNA, 21 bp, Artificial Sequence
  Description of Artificial Sequence: Target Sequence/siNA sense region (stab07)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(3): 2'-deoxy
  misc_feature (4)..(5): 2'-deoxy-2'Fluoro
  misc_feature (6)..(6): 2'-deoxy
  misc_feature (7)..(7): 2'-deoxy-2'Fluoro
  misc_feature (8)..(13): 2'-deoxy
  misc_feature (14)..(17): 2'-deoxy-2'Fluoro
  misc_feature (18)..(18): 2'-deoxy
  misc_feature (19)..(19): 2'-deoxy-2'Fluoro
  misc_feature (1)..(19): ribonucleotide unmodified or modified as described for this sequence
gggucgcgaaaggccuugutt

SEQ ID NO: 2072 - DNA, 21 bp, Artificial Sequence
  Description of Artificial Sequence: Target Sequence/siNA antisense region (stab25)
  misc_feature (20)..(20): Phosphorothioate or Phosphorodithioate 3'-Internucleotide Linkage (optionally present)
  misc_feature (4)..(4): 2'-deoxy-2'Fluoro
  misc_feature (5)..(5): 2'-O-methyl
  misc_feature (6)..(11): 2'-deoxy-2'Fluoro
  misc_feature (12)..(12): 2'-O-methyl
  misc_feature (13)..(13): 2'-deoxy-2'Fluoro
  misc_feature (14)..(14): 2'-O-methyl
  misc_feature (15)..(15): 2'-deoxy-2'Fluoro
  misc_feature (16)..(19): 2'-O-methyl
  misc_feature (1)..(19): ribonucleotide unmodified or modified as described for this sequence
agacgcuuucugcgugaagtt

SEQ ID NO: 2073 - DNA, 21 bp, Artificial Sequence
  Description of Artificial Sequence: Target Sequence/siNA antisense region (stab25)
  misc_feature (20)..(20): Phosphorothioate or Phosphorodithioate 3'-Internucleotide Linkage (optionally present)
  misc_feature (4)..(4): 2'-deoxy-2'Fluoro
  misc_feature (5)..(5): 2'-O-methyl
  misc_feature (6)..(7): 2'-deoxy-2'Fluoro
  misc_feature (8)..(8): 2'-O-methyl
  misc_feature (9)..(9): 2'-deoxy-2'Fluoro
  misc_feature (10)..(11): 2'-O-methyl
  misc_feature (12)..(13): 2'-deoxy-2'Fluoro
  misc_feature (14)..(16): 2'-O-methyl
  misc_feature (17)..(17): 2'-deoxy-2'Fluoro
  misc_feature (18)..(18): 2'-O-methyl
  misc_feature (19)..(19): 2'-deoxy-2'Fluoro
  misc_feature (1)..(19): ribonucleotide unmodified or modified as described for this sequence
uaacgccauggcuagacgctt

SEQ ID NO: 2074 - DNA, 21 bp, Artificial Sequence
  Description of Artificial Sequence: Target Sequence/siNA antisense region (stab25)
  misc_feature (20)..(20): Phosphorothioate or Phosphorodithioate 3'-Internucleotide Linkage (optionally present)
  misc_feature (4)..(4): 2'-O-methyl
  misc_feature (5)..(6): 2'-deoxy-2'Fluoro
  misc_feature (7)..(7): 2'-O-methyl
  misc_feature (8)..(8): 2'-deoxy-2'Fluoro
  misc_feature (9)..(10): 2'-O-methyl
  misc_feature (11)..(17): 2'-deoxy-2'Fluoro
  misc_feature (18)..(19): 2'-O-methyl
  misc_feature (1)..(19): ribonucleotide unmodified or modified as described for this sequence
accacuauggcucucccggtt

SEQ ID NO: 2075 - DNA, 21 bp, Artificial Sequence
  Description of Artificial Sequence: Target Sequence/siNA antisense region (stab25)
  misc_feature (20)..(20): Phosphorothioate or Phosphorodithioate 3'-Internucleotide Linkage (optionally present)
  misc_feature (4)..(4): 2'-deoxy-2'Fluoro
  misc_feature (5)..(5): 2'-O-methyl
  misc_feature (6)..(7): 2'-deoxy-2'Fluoro
  misc_feature (8)..(9): 2'-O-methyl
  misc_feature (10)..(13): 2'-deoxy-2'Fluoro
  misc_feature (14)..(14): 2'-O-methyl
  misc_feature (15)..(15): 2'-deoxy-2'Fluoro
  misc_feature (16)..(18): 2'-O-methyl
  misc_feature (19)..(19): 2'-deoxy-2'Fluoro
  misc_feature (1)..(19): ribonucleotide unmodified or modified as described for this sequence
acucaccgguuccgcagactt

SEQ ID NO: 2076 - DNA, 21 bp, Artificial Sequence
  Description of Artificial Sequence: Target Sequence/siNA antisense region (stab25)
  misc_feature (20)..(20): Phosphorothioate or Phosphorodithioate 3'-Internucleotide Linkage (optionally present)
  misc_feature (4)..(4): 2'-deoxy-2'Fluoro
  misc_feature (5)..(6): 2'-O-methyl
  misc_feature (7)..(10): 2'-deoxy-2'Fluoro
  misc_feature (11)..(12): 2'-O-methyl
  misc_feature (13)..(13): 2'-deoxy-2'Fluoro
  misc_feature (14)..(14): 2'-O-methyl
  misc_feature (15)..(15): 2'-deoxy-2'Fluoro
  misc_feature (16)..(16): 2'-O-methyl
  misc_feature (17)..(19): 2'-deoxy-2'Fluoro
  misc_feature (1)..(19): ribonucleotide unmodified or modified as described for this sequence
uggcaauuccgguguacuctt

SEQ ID NO: 2077 - DNA, 21 bp, Artificial Sequence
  Description of Artificial Sequence: Target Sequence/siNA antisense region (stab25)
  misc_feature (20)..(20): Phosphorothioate or Phosphorodithioate 3'-Internucleotide Linkage (optionally present)
  misc_feature (4)..(12): 2'-O-methyl
  misc_feature (13)..(15): 2'-deoxy-2'Fluoro
  misc_feature (16)..(17): 2'-O-methyl
  misc_feature (18)..(19): 2'-deoxy-2'Fluoro
  misc_feature (1)..(19): ribonucleotide unmodified or modified as described for this sequence
uccaagaaaggacccgguctt

SEQ ID NO: 2078 - DNA, 21 bp, Artificial Sequence
  Description of Artificial Sequence: Target Sequence/siNA antisense region (stab25)
  misc_feature (20)..(20): Phosphorothioate or Phosphorodithioate 3'-Internucleotide Linkage (optionally present)
  misc_feature (4)..(7): 2'-deoxy-2'Fluoro
  misc_feature (8)..(10): 2'-O-methyl
  misc_feature (11)..(11): 2'-deoxy-2'Fluoro
  misc_feature (12)..(12): 2'-O-methyl
  misc_feature (13)..(14): 2'-deoxy-2'Fluoro
  misc_feature (15)..(17): 2'-O-methyl
  misc_feature (18)..(18): 2'-deoxy-2'Fluoro
  misc_feature (19)..(19): 2'-O-methyl
  misc_feature (1)..(19): ribonucleotide unmodified or modified as described for this sequence
aaucuccaggcauugagcgtt

SEQ ID NO: 2079 - DNA, 21 bp, Artificial Sequence
  Description of Artificial Sequence: Target Sequence/siNA antisense region (stab25)
  misc_feature (20)..(20): Phosphorothioate or Phosphorodithioate 3'-Internucleotide Linkage (optionally present)
  misc_feature (4)..(4): 2'-O-methyl
  misc_feature (5)..(6): 2'-deoxy-2'Fluoro
  misc_feature (7)..(8): 2'-O-methyl
  misc_feature (9)..(9): 2'-deoxy-2'Fluoro
  misc_feature (10)..(11): 2'-O-methyl
  misc_feature (12)..(15): 2'-deoxy-2'Fluoro
  misc_feature (16)..(16): 2'-O-methyl
  misc_feature (17)..(17): 2'-deoxy-2'Fluoro
  misc_feature (18)..(19): 2'-O-methyl
  misc_feature (1)..(19): ribonucleotide unmodified or modified as described for this sequence
ucggcuagcagucucgcggtt

SEQ ID NO: 2080 - DNA, 21 bp, Artificial Sequence
  Description of Artificial Sequence: Target Sequence/siNA antisense region (stab25)
  misc_feature (20)..(20): Phosphorothioate or Phosphorodithioate 3'-Internucleotide Linkage (optionally present)
  misc_feature (4)..(4): 2'-deoxy-2'Fluoro
  misc_feature (5)..(6): 2'-O-methyl
  misc_feature (7)..(8): 2'-deoxy-2'Fluoro
  misc_feature (9)..(10): 2'-O-methyl
  misc_feature (11)..(11): 2'-deoxy-2'Fluoro
  misc_feature (12)..(13): 2'-O-methyl
  misc_feature (14)..(17): 2'-deoxy-2'Fluoro
  misc_feature (18)..(18): 2'-O-methyl
  misc_feature (19)..(19): 2'-deoxy-2'Fluoro
  misc_feature (1)..(19): ribonucleotide unmodified or modified as described for this sequence
acucggcuagcagucucgctt

SEQ ID NO: 2081 - DNA, 21 bp, Artificial Sequence
  Description of Artificial Sequence: Target Sequence/siNA antisense region (stab25)
  misc_feature (20)..(20): Phosphorothioate or Phosphorodithioate 3'-Internucleotide Linkage (optionally present)
  misc_feature (4)..(4): 2'-deoxy-2'Fluoro
  misc_feature (5)..(6): 2'-O-methyl
  misc_feature (7)..(9): 2'-deoxy-2'Fluoro
  misc_feature (10)..(11): 2'-O-methyl
  misc_feature (12)..(12): 2'-deoxy-2'Fluoro
  misc_feature (13)..(13): 2'-O-methyl
  misc_feature (14)..(15): 2'-deoxy-2'Fluoro
  misc_feature (16)..(16): 2'-O-methyl
  misc_feature (17)..(19): 2'-deoxy-2'Fluoro
  misc_feature (1)..(19): ribonucleotide unmodified or modified as described for this sequence
ucgcgacccaacacuacuctt

SEQ ID NO: 2082 - DNA, 21 bp, Artificial Sequence
  Description of Artificial Sequence: Target Sequence/siNA antisense region (stab25)
  misc_feature (20)..(20): Phosphorothioate or Phosphorodithioate 3'-Internucleotide Linkage (optionally present)
  misc_feature (4)..(9): 2'-deoxy-2'Fluoro
  misc_feature (10)..(10): 2'-O-methyl
  misc_feature (11)..(11): 2'-deoxy-2'Fluoro
  misc_feature (12)..(13): 2'-O-methyl
  misc_feature (14)..(16): 2'-deoxy-2'Fluoro
  misc_feature (17)..(18): 2'-O-methyl
  misc_feature (19)..(19): 2'-deoxy-2'Fluoro
  misc_feature (1)..(19): ribonucleotide unmodified or modified as described for this sequence
aggccuuucgcgacccaactt

SEQ ID NO: 2083 - DNA, 21 bp, Artificial Sequence
  Description of Artificial Sequence: Target Sequence/siNA antisense region (stab25)
  misc_feature (20)..(20): Phosphorothioate or Phosphorodithioate 3'-Internucleotide Linkage (optionally present)
  misc_feature (4)..(6): 2'-O-methyl
  misc_feature (7)..(12): 2'-deoxy-2'Fluoro
  misc_feature (13)..(13): 2'-O-methyl
  misc_feature (14)..(14): 2'-deoxy-2'Fluoro
  misc_feature (15)..(16): 2'-O-methyl
  misc_feature (17)..(19): 2'-deoxy-2'Fluoro
  misc_feature (1)..(19): ribonucleotide unmodified or modified as described for this sequence
acaaggccuuucgcgaccctt

SEQ ID NO: 2084 - DNA, 21 bp, Artificial Sequence
  Description of Artificial Sequence: Target Sequence/siNA antisense region (stab25)
  misc_feature (20)..(20): Phosphorothioate or Phosphorodithioate 3'-Internucleotide Linkage (optionally present)
  misc_feature (4)..(4): 2'-deoxy-2'Fluoro
  misc_feature (5)..(7): 2'-O-methyl
  misc_feature (8)..(8): 2'-deoxy-2'Fluoro
  misc_feature (9)..(9): 2'-O-methyl
  misc_feature (10)..(13): 2'-deoxy-2'Fluoro
  misc_feature (14)..(14): 2'-O-methyl
  misc_feature (15)..(16): 2'-deoxy-2'Fluoro
  misc_feature (17)..(19): 2'-O-methyl
  misc_feature (1)..(19): ribonucleotide unmodified or modified as described for this sequence
ucgcaagcacccuaucaggtt

SEQ ID NO: 2085 - DNA, 21 bp, Artificial Sequence
  Description of Artificial Sequence: Target Sequence/siNA antisense region (stab25)
  misc_feature (20)..(20): Phosphorothioate or Phosphorodithioate 3'-Internucleotide Linkage (optionally present)
  misc_feature (4)..(4): 2'-O-methyl
  misc_feature (5)..(7): 2'-deoxy-2'Fluoro
  misc_feature (8)..(8): 2'-O-methyl
  misc_feature (9)..(9): 2'-deoxy-2'Fluoro
  misc_feature (10)..(13): 2'-O-methyl
  misc_feature (14)..(19): 2'-deoxy-2'Fluoro
  misc_feature (1)..(19): ribonucleotide unmodified or modified as described for this sequence
acggucuacgagaccuccctt

SEQ ID NO: 2086 - DNA, 21 bp, Artificial Sequence
  Description of Artificial Sequence: Target Sequence/siNA sense region (stab04)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (4)..(4): 2'-deoxy-2'Fluoro
  misc_feature (6)..(8): 2'-deoxy-2'Fluoro
  misc_feature (10)..(10): 2'-deoxy-2'Fluoro
  misc_feature (15)..(15): 2'-deoxy-2'Fluoro
  misc_feature (18)..(19): 2'-deoxy-2'Fluoro
  misc_feature (1)..(19): ribonucleotide unmodified or modified as described for this sequence
gagcguucgugggauaguctt

SEQ ID NO: 2087 - DNA, 21 bp, Artificial Sequence
  Description of Artificial Sequence: Target Sequence/siNA antisense region (stab29A)
  misc_feature (20)..(20): Phosphorothioate or Phosphorodithioate 3'-Internucleotide Linkage (optionally present)
  misc_feature (3)..(8): 2'-deoxy-2'Fluoro
  misc_feature (9)..(12): 2'-O-methyl
  misc_feature (13)..(13): 2'-deoxy-2'Fluoro
  misc_feature (14)..(14): 2'-O-methyl
  misc_feature (15)..(17): 2'-deoxy-2'Fluoro
  misc_feature (1)..(19): ribonucleotide unmodified or modified as described for this sequence
ggcccuccagagcaucuggtt

SEQ ID NO: 2088 - RNA, 25 nt, Artificial Sequence
  Description of Artificial Sequence: Target Sequence/siNA sense region (stab00)
uuuguagccaaauccuuucugguac

SEQ ID NO: 2089 - RNA, 27 nt, Artificial Sequence
  Description of Artificial Sequence: Target Sequence/siNA sense region (stab00)
uuuuuguagccaaauccuuugugguac

SEQ ID NO: 2090 - RNA, 27 nt, Artificial Sequence
  Description of Artificial Sequence: Target Sequence/siNA sense region (stab00)
ccuggaucaugaaguccuuugugguac

SEQ ID NO: 2091 - RNA, 27 nt, Artificial Sequence
  Description of Artificial Sequence: Target Sequence/siNA sense region (stab00)
ugucugucuuggugcucuccuugcgag

SEQ ID NO: 2092 - RNA, 24 nt, Artificial Sequence
  Description of Artificial Sequence: Target Sequence/siNA sense region (stab00)
uguuuuuggaacagucuuugcgag

SEQ ID NO: 2093 - RNA, 26 nt, Artificial Sequence
  Description of Artificial Sequence: Target Sequence/siNA sense region (stab00)
ugucugucuuggugcucucguagacc

SEQ ID NO: 2094 - RNA, 27 nt, Artificial Sequence
  Description of Artificial Sequence: Target Sequence/siNA sense region (stab00)
cuuuccuccugugccaucucguagacc

SEQ ID NO: 2095 - RNA, 25 nt, Artificial Sequence
  Description of Artificial Sequence: Target Sequence/siNA antisense region (stab00)
guaccacaaggccuuucgcuacaaa

SEQ ID NO: 2096 - RNA, 27 nt, Artificial Sequence
  Description of Artificial Sequence: Target Sequence/siNA antisense region (stab00)
guaccacaaggccuuucgcuacaaaaa

SEQ ID NO: 2097 - RNA, 27 nt, Artificial Sequence
  Description of Artificial Sequence: Target Sequence/siNA antisense region (stab00)
guaccacaaggccuuucgcgauccagg

SEQ ID NO: 2098 - RNA, 27 nt, Artificial Sequence
  Description of Artificial Sequence: Target Sequence/siNA antisense region (stab00)
cucgcaagcacccuaucaggacagaca

SEQ ID NO: 2099 - RNA, 24 nt, Artificial Sequence
  Description of Artificial Sequence: Target Sequence/siNA antisense region (stab00)
cucgcaagcacccuaucagaaaca

SEQ ID NO: 2100 - RNA, 26 nt, Artificial Sequence
  Description of Artificial Sequence: Target Sequence/siNA antisense region (stab00)
ggucuacgagaccucccggacagaca

SEQ ID NO: 2101 - RNA, 27 nt, Artificial Sequence
  Description of Artificial Sequence: Target Sequence/siNA antisense region (stab00)
ggucuacgagaccucccgggaggaaag

SEQ ID NO: 2102 - DNA, 21 bp, Artificial Sequence
  Description of Artificial Sequence: Target Sequence/siNA antisense region (stab36)
  misc_feature (4)..(4): 2'-O-methyl
  misc_feature (5)..(5): 2'-deoxy-2'Fluoro
  misc_feature (6)..(8): 2'-O-methyl
  misc_feature (9)..(9): 2'-deoxy-2'Fluoro
  misc_feature (10)..(10): 2'-O-methyl
  misc_feature (11)..(14): 2'-deoxy-2'Fluoro
  misc_feature (15)..(15): 2'-O-methyl
  misc_feature (16)..(17): 2'-deoxy-2'Fluoro
  misc_feature (18)..(21): 2'-O-methyl
  misc_feature (1)..(19): ribonucleotide unmodified or modified as described for this sequence
cucgcaagcacccuaucaggc

SEQ ID NO: 2103 - DNA, 21 bp, Artificial Sequence
  Description of Artificial Sequence: Target Sequence/siNA antisense region (stab36)
  misc_feature (4)..(5): 2'-deoxy-2'Fluoro
  misc_feature (6)..(6): 2'-O-methyl
  misc_feature (7)..(7): 2'-deoxy-2'Fluoro
  misc_feature (8)..(11): 2'-O-methyl
  misc_feature (12)..(17): 2'-deoxy-2'Fluoro
  misc_feature (18)..(21): 2'-O-methyl
  misc_feature (1)..(19): ribonucleotide unmodified or modified as described for this sequence
ggucuacgagaccucccgggg

SEQ ID NO: 2104 - DNA, 21 bp, Artificial Sequence
  Description of Artificial Sequence: Target Sequence/siNA sense region (stab07B)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(1): 2'-deoxy
  misc_feature (2)..(2): 2'-deoxy-2'Fluoro
  misc_feature (3)..(8): 2'-deoxy
  misc_feature (11)..(12): 2'-deoxy-2'Fluoro
  misc_feature (13)..(13): 2'-deoxy
  misc_feature (14)..(14): 2'-deoxy-2'Fluoro
  misc_feature (15)..(16): 2'-deoxy
  misc_feature (17)..(17): 2'-deoxy-2'Fluoro
  misc_feature (18)..(18): 2'-deoxy
  misc_feature (19)..(19): 2'-deoxy-2'Fluoro
  misc_feature (1)..(19): ribonucleotide unmodified or modified as described for this sequence
gcgaaaggccuugugguactt

SEQ ID NO: 2105 - DNA, 21 bp, Artificial Sequence
  Description of Artificial Sequence: Target Sequence/siNA sense region (stab07B)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(2): 2'-deoxy-2'Fluoro
  misc_feature (3)..(4): 2'-deoxy
  misc_feature (5)..(5): 2'-deoxy-2'Fluoro
  misc_feature (6)..(8): 2'-deoxy
  misc_feature (11)..(11): 2'-deoxy
  misc_feature (12)..(14): 2'-deoxy-2'Fluoro
  misc_feature (15)..(15): 2'-deoxy
  misc_feature (16)..(16): 2'-deoxy-2'Fluoro
  misc_feature (17)..(19): 2'-deoxy
  misc_feature (1)..(19): ribonucleotide unmodified or modified as described for this sequence
cugauagggugcuugcgagtt

SEQ ID NO: 2106 - DNA, 21 bp, Artificial Sequence
  Description of Artificial Sequence: Target Sequence/siNA sense region (stab07B)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(2): 2'-deoxy-2'Fluoro
  misc_feature (3)..(8): 2'-deoxy
  misc_feature (11)..(12): 2'-deoxy-2'Fluoro
  misc_feature (13)..(13): 2'-deoxy
  misc_feature (14)..(14): 2'-deoxy-2'Fluoro
  misc_feature (15)..(17): 2'-deoxy
  misc_feature (18)..(19): 2'-deoxy-2'Fluoro
  misc_feature (1)..(19): ribonucleotide unmodified or modified as described for this sequence
ccgggaggucucguagacctt

SEQ ID NO: 2107 - DNA, 21 bp, Artificial Sequence
  Description of Artificial Sequence: Target Sequence/siNA antisense region (stab35)
  misc_feature (4)..(5): 2'-deoxy-2'Fluoro
  misc_feature (6)..(7): 2'-O-methyl
  misc_feature (8)..(11): 2'-deoxy-2'Fluoro
  misc_feature (12)..(13): 2'-O-methyl
  misc_feature (14)..(17): 2'-deoxy-2'Fluoro
  misc_feature (18)..(21): 2'-O-methyl
  misc_feature (1)..(19): ribonucleotide unmodified or modified as described for this sequence
ggucuagcucuggucccgguu

SEQ ID NO: 2108 - DNA, 19 bp, Artificial Sequence
  Description of Artificial Sequence: Target Sequence/siNA sense region (stab07C)
  misc_feature (1)..(1): 5'-3 attached terminal deoxyabasic moiety, inverted abasic, inverted nucleotide or other terminal cap that is optionally present
  misc_feature (19)..(19): 3'-3 attached terminal deoxyabasic moiety, inverted abasic, inverted nucleotide or other terminal cap that is optionally present
  misc_feature (1)..(1): 2'-deoxy
  misc_feature (2)..(2): 2'-deoxy-2'Fluoro
  misc_feature (3)..(8): 2'-deoxy
  misc_feature (11)..(12): 2'-deoxy-2'Fluoro
  misc_feature (13)..(13): 2'-deoxy
  misc_feature (14)..(14): 2'-deoxy-2'Fluoro
  misc_feature (15)..(16): 2'-deoxy
  misc_feature (17)..(17): 2'-deoxy-2'Fluoro
  misc_feature (18)..(18): 2'-deoxy
  misc_feature (19)..(19): 2'-deoxy-2'Fluoro
  misc_feature (1)..(19): ribonucleotide unmodified or modified as described for this sequence
gcgaaaggccuugugguac

SEQ ID NO: 2109 - DNA, 19 bp, Artificial Sequence
  Description of Artificial Sequence: Target Sequence/siNA sense region (stab07C)
  misc_feature (1)..(1): 5'-3 attached terminal deoxyabasic moiety, inverted abasic, inverted nucleotide or other terminal cap that is optionally present
  misc_feature (19)..(19): 3'-3 attached terminal deoxyabasic moiety, inverted abasic, inverted nucleotide or other terminal cap that is optionally present
  misc_feature (1)..(2): 2'-deoxy-2'Fluoro
  misc_feature (3)..(4): 2'-deoxy
  misc_feature (5)..(5): 2'-deoxy-2'Fluoro
  misc_feature (6)..(8): 2'-deoxy
  misc_feature (11)..(11): 2'-deoxy
  misc_feature (12)..(14): 2'-deoxy-2'Fluoro
  misc_feature (15)..(15): 2'-deoxy
  misc_feature (16)..(16): 2'-deoxy-2'Fluoro
  misc_feature (17)..(19): 2'-deoxy
  misc_feature (1)..(19): ribonucleotide unmodified or modified as described for this sequence
cugauagggugcuugcgag

SEQ ID NO: 2110 - DNA, 19 bp, Artificial Sequence
  Description of Artificial Sequence: Target Sequence/siNA sense region (stab07C)
  misc_feature (1)..(1): 5'-3 attached terminal deoxyabasic moiety, inverted abasic, inverted nucleotide or other terminal cap that is optionally present
  misc_feature (19)..(19): 3'-3 attached terminal deoxyabasic moiety, inverted abasic, inverted nucleotide or other terminal cap that is optionally present
  misc_feature (1)..(2): 2'-deoxy-2'Fluoro
  misc_feature (3)..(8): 2'-deoxy
  misc_feature (11)..(12): 2'-deoxy-2'Fluoro
  misc_feature (13)..(13): 2'-deoxy
  misc_feature (14)..(14): 2'-deoxy-2'Fluoro
  misc_feature (15)..(17): 2'-deoxy
  misc_feature (18)..(19): 2'-deoxy-2'Fluoro
  misc_feature (1)..(19): ribonucleotide unmodified or modified as described for this sequence
ccgggaggucucguagacc

SEQ ID NO: 2111 - DNA, 19 bp, Artificial Sequence
  Description of Artificial Sequence: Target Sequence/siNA sense region (stab07D)
  misc_feature (1)..(1): 5'-3 attached terminal deoxyabasic moiety, inverted abasic, inverted nucleotide or other terminal cap that is optionally present
  misc_feature (1)..(1): 2'-deoxy
  misc_feature (2)..(2): 2'-deoxy-2'Fluoro
  misc_feature (3)..(8): 2'-deoxy
  misc_feature (11)..(12): 2'-deoxy-2'Fluoro
  misc_feature (13)..(13): 2'-deoxy
  misc_feature (14)..(14): 2'-deoxy-2'Fluoro
  misc_feature (15)..(16): 2'-deoxy
  misc_feature (17)..(17): 2'-deoxy-2'Fluoro
  misc_feature (18)..(18): 2'-deoxy
  misc_feature (19)..(19): 2'-deoxy-2'Fluoro
  misc_feature (1)..(19): ribonucleotide unmodified or modified as described for this sequence
gcgaaaggccuugugguac

SEQ ID NO: 2112 - DNA, 19 bp, Artificial Sequence
  Description of Artificial Sequence: Target Sequence/siNA sense region (stab07D)
  misc_feature (1)..(1): 5'-3 attached terminal deoxyabasic moiety, inverted abasic, inverted nucleotide or other terminal cap that is optionally present
  misc_feature (1)..(2): 2'-deoxy-2'Fluoro
  misc_feature (3)..(4): 2'-deoxy
  misc_feature (5)..(5): 2'-deoxy-2'Fluoro
  misc_feature (6)..(8): 2'-deoxy
  misc_feature (11)..(11): 2'-deoxy
  misc_feature (12)..(14): 2'-deoxy-2'Fluoro
  misc_feature (15)..(15): 2'-deoxy
  misc_feature (16)..(16): 2'-deoxy-2'Fluoro
  misc_feature (17)..(19): 2'-deoxy
  misc_feature (1)..(19): ribonucleotide unmodified or modified as described for this sequence
cugauagggugcuugcgag

SEQ ID NO: 2113 - DNA, 19 bp, Artificial Sequence
  Description of Artificial Sequence: Target Sequence/siNA sense region (stab07)
  misc_feature (1)..(1): 5'-3 attached terminal deoxyabasic moiety, inverted abasic, inverted nucleotide or other terminal cap that is optionally present
  misc_feature (1)..(2): 2'-deoxy-2'Fluoro
  misc_feature (3)..(8): 2'-deoxy
  misc_feature (11)..(12): 2'-deoxy-2'Fluoro
  misc_feature (13)..(13): 2'-deoxy
  misc_feature (14)..(14): 2'-deoxy-2'Fluoro
  misc_feature (15)..(17): 2'-deoxy
  misc_feature (18)..(19): 2'-deoxy-2'Fluoro
  misc_feature (1)..(19): ribonucleotide unmodified or modified as described for this sequence
ccgggaggucucguagacc

SEQ ID NO: 2114 - DNA, 21 bp, Artificial Sequence
  Description of Artificial Sequence: Target Sequence/siNA sense region (stab07B)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(4): 2'-deoxy-2'Fluoro
  misc_feature (5)..(5): 2'-deoxy
  misc_feature (6)..(6): 2'-deoxy-2'Fluoro
  misc_feature (7)..(7): 2'-deoxy
  misc_feature (8)..(8): 2'-deoxy-2'Fluoro
  misc_feature (11)..(14): 2'-deoxy
  misc_feature (15)..(15): 2'-deoxy-2'Fluoro
  misc_feature (16)..(16): 2'-deoxy
  misc_feature (17)..(19): 2'-deoxy-2'Fluoro
  misc_feature (1)..(19): ribonucleotide unmodified or modified as described for this sequence
cuucacgcagaaagcgucutt

SEQ ID NO: 2115 - DNA, 21 bp, Artificial Sequence
  Description of Artificial Sequence: Target Sequence/siNA sense region (stab07B)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(1): 2'-deoxy
  misc_feature (2)..(2): 2'-deoxy-2'Fluoro
  misc_feature (3)..(3): 2'-deoxy
  misc_feature (4)..(6): 2'-deoxy-2'Fluoro
  misc_feature (7)..(8): 2'-deoxy
  misc_feature (11)..(11): 2'-deoxy
  misc_feature (12)..(12): 2'-deoxy-2'Fluoro
  misc_feature (13)..(14): 2'-deoxy
  misc_feature (15)..(15): 2'-deoxy-2'Fluoro
  misc_feature (16)..(16): 2'-deoxy
  misc_feature (17)..(18): 2'-deoxy-2'Fluoro
  misc_feature (19)..(19): 2'-deoxy
  misc_feature (1)..(19): ribonucleotide unmodified or modified as described for this sequence
gcgucuagccauggcguuatt

SEQ ID NO: 2116 - DNA, 21 bp, Artificial Sequence
  Description of Artificial Sequence: Target Sequence/siNA sense region (stab07B)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(2): 2'-deoxy-2'Fluoro
  misc_feature (3)..(8): 2'-deoxy
  misc_feature (11)..(11): 2'-deoxy-2'Fluoro
  misc_feature (12)..(12): 2'-deoxy
  misc_feature (13)..(13): 2'-deoxy-2'Fluoro
  misc_feature (14)..(15): 2'-deoxy
  misc_feature (16)..(16): 2'-deoxy-2'Fluoro
  misc_feature (17)..(18): 2'-deoxy
  misc_feature (19)..(19): 2'-deoxy-2'Fluoro
  misc_feature (1)..(19): ribonucleotide unmodified or modified as described for this sequence
ccgggagagccauaguggutt

SEQ ID NO: 2117 - DNA, 21 bp, Artificial Sequence
  Description of Artificial Sequence: Target Sequence/siNA sense region (stab07B)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(1): 2'-deoxy
  misc_feature (2)..(4): 2'-deoxy-2'Fluoro
  misc_feature (5)..(5): 2'-deoxy
  misc_feature (6)..(6): 2'-deoxy-2'Fluoro
  misc_feature (7)..(8): 2'-deoxy
  misc_feature (11)..(12): 2'-deoxy-2'Fluoro
  misc_feature (13)..(14): 2'-deoxy
  misc_feature (15)..(15): 2'-deoxy-2'Fluoro
  misc_feature (16)..(18): 2'-deoxy
  misc_feature (19)..(19): 2'-deoxy-2'Fluoro
  misc_feature (1)..(19): ribonucleotide unmodified or modified as described for this sequence
gucugcggaaccggugagutt

SEQ ID NO: 2118 - DNA, 21 bp, Artificial Sequence
  Description of Artificial Sequence: Target Sequence/siNA sense region (stab07B)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(3): 2'-deoxy-2'Fluoro
  misc_feature (4)..(5): 2'-deoxy
  misc_feature (6)..(6): 2'-deoxy-2'Fluoro
  misc_feature (7)..(8): 2'-deoxy
  misc_feature (11)..(11): 2'-deoxy-2'Fluoro
  misc_feature (12)..(12): 2'-deoxy
  misc_feature (13)..(15): 2'-deoxy-2'Fluoro
  misc_feature (16)..(16): 2'-deoxy
  misc_feature (17)..(17): 2'-deoxy-2'Fluoro
  misc_feature (18)..(19): 2'-deoxy
  misc_feature (1)..(19): ribonucleotide unmodified or modified as described for this sequence
ccugauagggugcuugcgatt

SEQ ID NO: 2119 - DNA, 21 bp, Artificial Sequence
  Description of Artificial Sequence: Target Sequence/siNA sense region (stab07B)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(6): 2'-deoxy
  misc_feature (7)..(8): 2'-deoxy-2'Fluoro
  misc_feature (11)..(11): 2'-deoxy
  misc_feature (12)..(12): 2'-deoxy-2'Fluoro
  misc_feature (13)..(15): 2'-deoxy
  misc_feature (16)..(17): 2'-deoxy-2'Fluoro
  misc_feature (18)..(18): 2'-deoxy
  misc_feature (19)..(19): 2'-deoxy-2'Fluoro
  misc_feature (1)..(19): ribonucleotide unmodified or modified as described for this sequence
gggaggucucguagaccgutt

SEQ ID NO: 2120 - DNA, 21 bp, Artificial Sequence
  Description of Artificial Sequence: Target Sequence/siNA sense region (stab09)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(19): ribonucleotide unmodified or modified as described for this sequence
cuucacgcagaaagcgucutt

SEQ ID NO: 2121 - DNA, 21 bp, Artificial Sequence
  Description of Artificial Sequence: Target Sequence/siNA sense region (stab09)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(19): ribonucleotide unmodified or modified as described for this sequence
gcgucuagccauggcguuatt

SEQ ID NO: 2122 - DNA, 21 bp, Artificial Sequence
  Description of Artificial Sequence: Target Sequence/siNA sense region (stab09)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(19): ribonucleotide unmodified or modified as described for this sequence
ccgggagagccauaguggutt

SEQ ID NO: 2123 - DNA, 21 bp, Artificial Sequence
  Description of Artificial Sequence: Target Sequence/siNA sense region (stab09)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(19): ribonucleotide unmodified or modified as described for this sequence
gucugcggaaccggugagutt

SEQ ID NO: 2124 - DNA, 21 bp, Artificial Sequence
  Description of Artificial Sequence: Target Sequence/siNA sense region (stab09)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(19): ribonucleotide unmodified or modified as described for this sequence
ccugauagggugcuugcgatt

SEQ ID NO: 2125 - DNA, 21 bp, Artificial Sequence
  Description of Artificial Sequence: Target Sequence/siNA sense region (stab09)
  misc_feature (1)..(1): 5'-3 attached terminal deoxyabasic moiety, inverted abasic, inverted nucleotide or other terminal cap that is optionally present
  misc_feature (21)..(21): 3'-3 attached terminal deoxyabasic moiety, inverted abasic, inverted nucleotide or other terminal cap that is optionally present
  misc_feature (1)..(19): ribonucleotide unmodified or modified as described for this sequence
gggaggucucguagaccgutt

SEQ ID NO: 2126 - DNA, 21 bp, Artificial Sequence
  Description of Artificial Sequence: Target Sequence/siNA antisense region (stab10)
  misc_feature (20)..(20): Phosphorothioate or Phosphorodithioate 3'-Internucleotide Linkage (optionally present)
  misc_feature (1)..(19): ribonucleotide unmodified or modified as described for this sequence
agacgcuuucugcgugaagtt

SEQ ID NO: 2127 - DNA, 21 bp, Artificial Sequence
  Description of Artificial Sequence: Target Sequence/siNA antisense region (stab10)
  misc_feature (20)..(20): Phosphorothioate or Phosphorodithioate 3'-Internucleotide Linkage (optionally present)
  misc_feature (1)..(19): ribonucleotide unmodified or modified as described for this sequence
uaacgccauggcuagacgctt

SEQ ID NO: 2128 - DNA, 21 bp, Artificial Sequence
  Description of Artificial Sequence: Target Sequence/siNA antisense region (stab10)
  misc_feature (20)..(20): Phosphorothioate or Phosphorodithioate 3'-Internucleotide Linkage (optionally present)
  misc_feature (1)..(19): ribonucleotide unmodified or modified as described for this sequence
accacuauggcucucccggtt

SEQ ID NO: 2129 - DNA, 21 bp, Artificial Sequence
  Description of Artificial Sequence: Target Sequence/siNA antisense region (stab10)
  misc_feature (20)..(20): Phosphorothioate or Phosphorodithioate 3'-Internucleotide Linkage (optionally present)
  misc_feature (1)..(19): ribonucleotide unmodified or modified as described for this sequence
acucaccgguuccgcagactt

SEQ ID NO: 2130 - DNA, 21 bp, Artificial Sequence
  Description of Artificial Sequence: Target Sequence/siNA antisense region (stab10)
  misc_feature (20)..(20): Phosphorothioate or Phosphorodithioate 3'-Internucleotide Linkage (optionally present)
  misc_feature (1)..(19): ribonucleotide unmodified or modified as described for this sequence
ucgcaagcacccuaucaggtt

SEQ ID NO: 2131 - DNA, 21 bp, Artificial Sequence
  Description of Artificial Sequence: Target Sequence/siNA antisense region (stab10)
  misc_feature (20)..(20): Phosphorothioate or Phosphorodithioate 3'-Internucleotide Linkage (optionally present)
  misc_feature (1)..(19): ribonucleotide unmodified or modified as described for this sequence
acggucuacgagaccuccctt

SEQ ID NO: 2132 - DNA, 21 bp, Artificial Sequence
  Description of Artificial Sequence: Target Sequence/siNA antisense region (stab25)
  misc_feature (20)..(20): Phosphorothioate or Phosphorodithioate 3'-Internucleotide Linkage (optionally present)
  misc_feature (4)..(4): 2'-deoxy-2'Fluoro
  misc_feature (6)..(11): 2'-deoxy-2'Fluoro
  misc_feature (13)..(13): 2'-deoxy-2'Fluoro
  misc_feature (15)..(15): 2'-deoxy-2'Fluoro
  misc_feature (1)..(19): ribonucleotide unmodified or modified as described for this sequence
agacgcuuucugcgugaagtt

SEQ ID NO: 2133 - DNA, 21 bp, Artificial Sequence
  Description of Artificial Sequence: Target Sequence/siNA antisense region (stab25)
  misc_feature (20)..(20): Phosphorothioate or Phosphorodithioate 3'-Internucleotide Linkage (optionally present)
  misc_feature (1)..(1): 2'-deoxy-2'Fluoro
  misc_feature (4)..(4): 2'-deoxy-2'Fluoro
  misc_feature (6)..(7): 2'-deoxy-2'Fluoro
  misc_feature (9)..(9): 2'-deoxy-2'Fluoro
  misc_feature (12)..(13): 2'-deoxy-2'Fluoro
  misc_feature (17)..(17): 2'-deoxy-2'Fluoro
  misc_feature (19)..(19): 2'-deoxy-2'Fluoro
  misc_feature (1)..(19): ribonucleotide unmodified or modified as described for this sequence
uaacgccauggcuagacgctt

SEQ ID NO: 2134 - DNA, 21 bp, Artificial Sequence
  Description of Artificial Sequence: Target Sequence/siNA antisense region (stab25)
  misc_feature (20)..(20): Phosphorothioate or Phosphorodithioate 3'-Internucleotide Linkage (optionally present)
  misc_feature (2)..(3): 2'-deoxy-2'Fluoro
  misc_feature (5)..(6): 2'-deoxy-2'Fluoro
  misc_feature (8)..(8): 2'-deoxy-2'Fluoro
  misc_feature (11)..(17): 2'-deoxy-2'Fluoro
  misc_feature (1)..(19): ribonucleotide unmodified or modified as described for this sequence
accacuauggcucucccggtt

SEQ ID NO: 2135 - DNA, 21 bp, Artificial Sequence
  Description of Artificial Sequence: Target Sequence/siNA antisense region (stab25)
  misc_feature (20)..(20): Phosphorothioate or Phosphorodithioate 3'-Internucleotide Linkage (optionally present)
  misc_feature (2)..(4): 2'-deoxy-2'Fluoro
  misc_feature (6)..(7): 2'-deoxy-2'Fluoro
  misc_feature (10)..(13): 2'-deoxy-2'Fluoro
  misc_feature (15)..(15): 2'-deoxy-2'Fluoro
  misc_feature (19)..(19): 2'-deoxy-2'Fluoro
  misc_feature (1)..(19): ribonucleotide unmodified or modified as described for this sequence
acucaccgguuccgcagactt

SEQ ID NO: 2136 - DNA, 21 bp, Artificial Sequence
  Description of Artificial Sequence: Target Sequence/siNA antisense region (stab25)
  misc_feature (20)..(20): Phosphorothioate or Phosphorodithioate 3'-Internucleotide Linkage (optionally present)
  misc_feature (1)..(2): 2'-deoxy-2'Fluoro
  misc_feature (4)..(4): 2'-deoxy-2'Fluoro
  misc_feature (8)..(8): 2'-deoxy-2'Fluoro
  misc_feature (10)..(13): 2'-deoxy-2'Fluoro
  misc_feature (15)..(16): 2'-deoxy-2'Fluoro
  misc_feature (1)..(19): ribonucleotide unmodified or modified as described for this sequence
ucgcaagcacccuaucaggtt

SEQ ID NO: 2137 - DNA, 21 bp, Artificial Sequence
  Description of Artificial Sequence: Target Sequence/siNA antisense region (stab25)
  misc_feature (20)..(20): Phosphorothioate or Phosphorodithioate 3'-Internucleotide Linkage (optionally present)
  misc_feature (2)..(2): 2'-deoxy-2'Fluoro
  misc_feature (5)..(7): 2'-deoxy-2'Fluoro
  misc_feature (9)..(9): 2'-deoxy-2'Fluoro
  misc_feature (14)..(19): 2'-deoxy-2'Fluoro
  misc_feature (1)..(19): ribonucleotide unmodified or modified as described for this sequence
acggucuacgagaccuccctt

SEQ ID NO: 2138 - DNA, 20 bp, Artificial Sequence
  Description of Artificial Sequence: Target Sequence/siNA sense region (stab07iB19)
  misc_feature (1)..(1): 5'-3 attached terminal deoxyabasic moiety, inverted abasic, inverted nucleotide or other terminal cap that is optionally present
  misc_feature (20)..(20): 3'-3 attached terminal deoxyabasic moiety, inverted abasic, inverted nucleotide or other terminal cap that is optionally present
  misc_feature (1)..(2): 2'-deoxy-2'Fluoro
  misc_feature (3)..(8): 2'-deoxy
  misc_feature (9)..(12): 2'-deoxy-2'Fluoro
  misc_feature (13)..(13): 2'-deoxy
  misc_feature (14)..(14): 2'-deoxy-2'Fluoro
  misc_feature (15)..(17): 2'-deoxy
  misc_feature (18)..(18): 2'-deoxy-2'Fluoro
  misc_feature (1)..(17): ribonucleotide unmodified or modified as described for this sequence
  misc_feature (17)..(18): inverted deoxy abasic moiety between nucleotides
ccgggaggucucguagactt

SEQ ID NO: 2139 - DNA, 20 bp, Artificial Sequence
  Description of Artificial Sequence: Target Sequence/siNA sense region (stab07iB19)
  misc_feature (1)..(1): 5'-3 attached terminal deoxyabasic moiety, inverted abasic, inverted nucleotide or other terminal cap that is optionally present
  misc_feature (20)..(20): 3'-3 attached terminal deoxyabasic moiety, inverted abasic, inverted nucleotide or other terminal cap that is optionally present
  misc_feature (1)..(2): 2'-deoxy-2'Fluoro
  misc_feature (3)..(4): 2'-deoxy
  misc_feature (5)..(5): 2'-deoxy-2'Fluoro
  misc_feature (6)..(9): 2'-deoxy
  misc_feature (10)..(10): 2'-deoxy-2'Fluoro
  misc_feature (11)..(11): 2'-deoxy
  misc_feature (12)..(14): 2'-deoxy-2'Fluoro
  misc_feature (15)..(15): 2'-deoxy
  misc_feature (16)..(16): 2'-deoxy-2'Fluoro
  misc_feature (17)..(18): 2'-deoxy
  misc_feature (1)..(17): ribonucleotide unmodified or modified as described for this sequence
  misc_feature (17)..(18): inverted deoxy abasic moiety between nucleotides
cugauagggugcuugcgatt

SEQ ID NO: 2140 - RNA, 20 nt, Artificial Sequence
  Description of Artificial Sequence: Target Sequence/siNA antisense region (stab36iB19)
  misc_feature (4)..(5): 2'-deoxy-2'Fluoro
  misc_feature (6)..(6): 2'-O-methyl
  misc_feature (7)..(7): 2'-deoxy-2'Fluoro
  misc_feature (8)..(11): 2'-O-methyl
  misc_feature (12)..(17): 2'-deoxy-2'Fluoro
  misc_feature (18)..(18): 2'-O-methyl
  misc_feature (19)..(20): 2'-O-methyl
  misc_feature (17)..(18): inverted deoxy abasic moiety between nucleotides
ggucuacgagaccucccggg

SEQ ID NO: 2141 - RNA, 20 nt, Artificial Sequence
  Description of Artificial Sequence: Target Sequence/siNA antisense region (stab36iB19)
  misc_feature (4)..(4): 2'-O-methyl
  misc_feature (5)..(5): 2'-deoxy-2'Fluoro
  misc_feature (6)..(8): 2'-O-methyl
  misc_feature (9)..(9): 2'-deoxy-2'Fluoro
  misc_feature (10)..(10): 2'-O-methyl
  misc_feature (11)..(14): 2'-deoxy-2'Fluoro
  misc_feature (15)..(15): 2'-O-methyl
  misc_feature (16)..(17): 2'-deoxy-2'Fluoro
  misc_feature (18)..(18): 2'-O-methyl
  misc_feature (19)..(20): 2'-O-methyl
  misc_feature (17)..(18): inverted deoxy abasic moiety between nucleotides
cucgcaagcacccuaucagc

SEQ ID NO: 2142 - DNA, 20 bp, Artificial Sequence
  Description of Artificial Sequence: Target Sequence/siNA sense region (stab07iB1)
  misc_feature (1)..(1): 5'-3 attached terminal deoxyabasic moiety, inverted abasic, inverted nucleotide or other terminal cap that is optionally present
  misc_feature (20)..(20): 3'-3 attached terminal deoxyabasic moiety, inverted abasic, inverted nucleotide or other terminal cap that is optionally present
  misc_feature (1)..(1): 2'-deoxy-2'Fluoro
  misc_feature (2)..(7): 2'-deoxy
  misc_feature (8)..(11): 2'-deoxy-2'Fluoro
  misc_feature (12)..(12): 2'-deoxy
  misc_feature (13)..(13): 2'-deoxy-2'Fluoro
  misc_feature (14)..(16): 2'-deoxy
  misc_feature (17)..(17): 2'-deoxy-2'Fluoro
  misc_feature (1)..(18): ribonucleotide unmodified or modified as described for this sequence
cgggaggucucguagacctt

SEQ ID NO: 2143 - DNA, 20 bp, Artificial Sequence
  Description of Artificial Sequence: Target Sequence/siNA sense region (stab07iB1)
  misc_feature (1)..(1): 5'-3 attached terminal deoxyabasic moiety, inverted abasic, inverted nucleotide or other terminal cap that is optionally present
  misc_feature (20)..(20): 3'-3 attached terminal deoxyabasic moiety, inverted abasic, inverted nucleotide or other terminal cap that is optionally present
  misc_feature (1)..(1): 2'-deoxy-2'Fluoro
  misc_feature (4)..(4): 2'-deoxy-2'Fluoro
  misc_feature (9)..(9): 2'-deoxy-2'Fluoro
  misc_feature (11)..(13): 2'-deoxy-2'Fluoro
  misc_feature (15)..(15): 2'-deoxy-2'Fluoro
  misc_feature (1)..(18): ribonucleotide unmodified or modified as described for this sequence
ugauagggugcuugcgagtt

SEQ ID NO: 2144 - RNA, 20 nt, Artificial Sequence
  Description of Artificial Sequence: Target Sequence/siNA antisense region (stab36iB1)
  misc_feature (1)..(1): 5'-3 attached terminal deoxyabasic moiety, inverted abasic, inverted nucleotide or other terminal cap that is optionally present
  misc_feature (1)..(2): 2'-O-methyl
  misc_feature (3)..(4): 2'-deoxy-2'Fluoro
  misc_feature (5)..(5): 2'-O-methyl
  misc_feature (6)..(6): 2'-deoxy-2'Fluoro
  misc_feature (7)..(10): 2'-O-methyl
  misc_feature (11)..(16): 2'-deoxy-2'Fluoro
  misc_feature (17)..(20): 2'-O-methyl
gucuacgagaccucccgggg

SEQ ID NO: 2145 - RNA, 20 nt, Artificial Sequence
  Description of Artificial Sequence: Target Sequence/siNA antisense region (stab36iB1)
  misc_feature (1)..(1): 5'-3 attached terminal deoxyabasic moiety, inverted abasic, inverted nucleotide or other terminal cap that is optionally present
  misc_feature (3)..(3): 2'-O-methyl
  misc_feature (4)..(4): 2'-deoxy-2'Fluoro
  misc_feature (5)..(7): 2'-O-methyl
  misc_feature (8)..(8): 2'-deoxy-2'Fluoro
  misc_feature (9)..(9): 2'-O-methyl
  misc_feature (10)..(13): 2'-deoxy-2'Fluoro
  misc_feature (14)..(14): 2'-O-methyl
  misc_feature (15)..(16): 2'-deoxy-2'Fluoro
  misc_feature (17)..(20): 2'-O-methyl
ucgcaagcacccuaucaggc

SEQ ID NO: 2146 - DNA, 20 bp, Artificial Sequence
  Description of Artificial Sequence: Target Sequence/siNA sense region (stab07iB9)
  misc_feature (1)..(1): 5'-3 attached terminal deoxyabasic moiety, inverted abasic, inverted nucleotide or other terminal cap that is optionally present
  misc_feature (20)..(20): 3'-3 attached terminal deoxyabasic moiety, inverted abasic, inverted nucleotide or other terminal cap that is optionally present
  misc_feature (1)..(2): 2'-deoxy-2'Fluoro
  misc_feature (3)..(8): 2'-deoxy
  misc_feature (9)..(11): 2'-deoxy-2'Fluoro
  misc_feature (12)..(12): 2'-deoxy
  misc_feature (13)..(13): 2'-deoxy-2'Fluoro
  misc_feature (14)..(16): 2'-deoxy
  misc_feature (17)..(18): 2'-deoxy-2'Fluoro
  misc_feature (1)..(18): ribonucleotide unmodified or modified as described for this sequence
ccgggaggcucguagacctt

SEQ ID NO: 2147 - DNA, 20 bp, Artificial Sequence
  Description of Artificial Sequence: Target Sequence/siNA sense region (stab07iB9)
  misc_feature (1)..(1): 5'-3 attached terminal deoxyabasic moiety, inverted abasic, inverted nucleotide or other terminal cap that is optionally present
  misc_feature (20)..(20): 3'-3 attached terminal deoxyabasic moiety, inverted abasic, inverted nucleotide or other terminal cap that is optionally present
  misc_feature (1)..(2): 2'-deoxy-2'Fluoro
  misc_feature (3)..(4): 2'-deoxy
  misc_feature (5)..(5): 2'-deoxy-2'Fluoro
  misc_feature (1)..(18): ribonucleotide unmodified or modified as described for this sequence
cugauaggugcuugcgagtt

SEQ ID NO: 2148 - RNA, 20 nt, Artificial Sequence
  Description of Artificial Sequence: Target Sequence/siNA antisense region (stab36iB9)
  misc_feature (4)..(5): 2'-deoxy-2'Fluoro
  misc_feature (6)..(6): 2'-O-methyl
  misc_feature (7)..(7): 2'-deoxy-2'Fluoro
  misc_feature (8)..(8): 2'-O-methyl
  misc_feature (9)..(10): 2'-O-methyl
  misc_feature (11)..(16): 2'-deoxy-2'Fluoro
  misc_feature (17)..(20): 2'-O-methyl
ggucuacggaccucccgggg

SEQ ID NO: 2149 - RNA, 20 nt, Artificial Sequence
  Description of Artificial Sequence: Target Sequence/siNA antisense region (stab36iB9)
  misc_feature (4)..(4): 2'-O-methyl
  misc_feature (5)..(5): 2'-deoxy-2'Fluoro
cucgcaagacccuaucaggc

SEQ ID NO: 2150 - DNA, 18 bp, Artificial Sequence
  Description of Artificial Sequence: neo-forward primer
ccggctacctgcccattc

SEQ ID NO: 2151 - DNA, 22 bp, Artificial Sequence
  Description of Artificial Sequence: neo-reverse primer
ccagatcatcctgatcgacaag

SEQ ID NO: 2152 - DNA, 24 bp, Artificial Sequence
  Description of Artificial Sequence: neo-probe
  misc_feature (1)..(1): 5' covalently linked reported dye FAM
  misc_feature (24)..(24): 3' conjugated quencher dye TAMARA
acatcgcatcgagcgagcacgtac

SEQ ID NO: 2153 - DNA, 24 bp, Artificial Sequence
  Description of Artificial Sequence: 36B4 forward primer
tctatcatcaacgggtacaaacga

SEQ ID NO: 2154 - DNA, 22 bp, Artificial Sequence
  Description of Artificial Sequence: 36B4- reverse primer
cttttcagcaagtgggaaggtg

SEQ ID NO: 2155 - DNA, 27 bp, Artificial Sequence
  Description of Artificial Sequence: 36B4 probe
  misc_feature (1)..(1): 5' covalently linked reported dye VIC
  misc_feature (27)..(27): 3' conjugated quencher dye TAMARA
cctggccttgtctgtggagacggatta

SEQ ID NO: 2156 - DNA, 21 bp, Artificial Sequence
  Description of Artificial Sequence:  siNA sense region
  misc_feature (1)..(1): 5'-3 attached terminal deoxyabasic moeity inverted abasic, inverted nucleotide or other terminal cap that is optionally present
  misc_feature (21)..(21): 3'-3 attached terminal deoxyabasic moeity inverted abasic, inverted nucleotide or other terminal cap that is optionally present
  misc_feature (20)..(21): n stands for any nucleotide
  misc_feature (1)..(19): ribonucleotide unmodified or modified as described for this sequence
nnnnnnnnnnnnnnnnnnnnn

SEQ ID NO: 2157 - DNA, 21 bp, Artificial Sequence
  Description of Artificial Sequence:  siNA antisense region
  misc_feature (20)..(20): Phosphorothioate or Phosphorodithioate 3'-Internucleotide Linkage (optionally present)
  misc_feature (20)..(21): n stands for any nucleotide
  misc_feature (21)..(21): attached terminal glyceryl moeity or 3'-3 attached inverted deoxyabasic (optionally present)
  misc_feature (1)..(19): ribonucleotide unmodified or modified as described for this sequence
nnnnnnnnnnnnnnnnnnnnn

SEQ ID NO: 2158 - DNA, 21 bp, Artificial Sequence
  Description of Artificial Sequence:  siNA sense region
  misc_feature (1)..(19): n stands for any ribonucleotide wherein any pyrimidine nucleotide present is 2'-OCF3 or 2'-Fluoro and all purine nucleotide is 2'-O-methyl
  misc_feature (20)..(20): Phosphorothioate or Phosphorodithioate 3'-Internucleotide Linkage (optionally present)
  misc_feature (20)..(21): n stands for any nucleotide
nnnnnnnnnnnnnnnnnnnnn

SEQ ID NO: 2159 - DNA, 21 bp, Artificial Sequence
  Description of Artificial Sequence:  siNA antisense region
  misc_feature (1)..(19): n stands for any ribonucleotide wherein any pyrimidine nucleotide present is 2'-OCF3 or 2'-Fluoro and all purine nucleotides are 2'-o-methyl
  misc_feature (20)..(20): Phosphorothioate or Phosphorodithioate 3'-Internucleotide Linkage (optionally present)
  misc_feature (20)..(21): n stands for any nucleotide
  misc_feature (21)..(21): attached terminal glyceryl moeity or 3'-3 attached inverted deoxyabasic (optionally present)
nnnnnnnnnnnnnnnnnnnnn

SEQ ID NO: 2160 - DNA, 21 bp, Artificial Sequence
  Description of Artificial Sequence:  siNA sense region
  misc_feature (1)..(19): n stands for any ribonucleotide wherein any pyrimidine nucleotide present is 2'-OCF3 or 2'-Fluoro
  misc_feature (20)..(21): n stands for any nucleotide
  misc_feature (1)..(1): 5'-3 attached terminal deoxyabasic moeity, inverted abasic, inverted nucleotide or other terminal cap that is optionally present
  misc_feature (21)..(21): 3'-3 attached terminal deoxyabasic moeity, inverted abasic, inverted nucleotide or other terminal cap that is optionally present
nnnnnnnnnnnnnnnnnnnnn

SEQ ID NO: 2161 - DNA, 21 bp, Artificial Sequence
  Description of Artificial Sequence:  siNA antisense region
  misc_feature (1)..(19): n stands for any ribonucleotide wherein any pyrimidine nucleotide present is 2'-OCF3 or 2'-Fluoro
  misc_feature (20)..(20): Phosphorothioate or Phosphorodithioate 3'-Internucleotide Linkage (optionally present)
  misc_feature (20)..(21): n stands for any nucleotide
  misc_feature (21)..(21): attached terminal glyceryl moeity or 3'-3 attached inverted deoxyabasic (optionally present)
nnnnnnnnnnnnnnnnnnnnn

SEQ ID NO: 2162 - DNA, 21 bp, Artificial Sequence
  Description of Artificial Sequence:  siNA sense region
  misc_feature (1)..(19): n stands for any ribonucleotide wherein any pyrimidine nucleotide present is 2'-OCF3 or 2'-Fluoro and any purine nucleotide present is 2'-Deoxy
  misc_feature (20)..(21): n stands for any nucleotide
  misc_feature (1)..(1): 5'-3 attached terminal deoxyabasic moeity, inverted abasic, inverted nucleotide or other terminal cap that is optionally present
  misc_feature (21)..(21): 3'-3 attached terminal deoxyabasic moeity, inverted abasic, inverted nucleotide or other terminal cap that is optionally present
nnnnnnnnnnnnnnnnnnnnn

SEQ ID NO: 2163 - DNA, 21 bp, Artificial Sequence
  Description of Artificial Sequence:  siNA sense region
  misc_feature (1)..(19): n stands for any ribonucleotide wherein any pyrimidine nucleotide present is 2'-Fluoro or 2'-OCF3 and any purine in 2'-deoxy
  misc_feature (20)..(21): n stands for any nucleotide
  misc_feature (21)..(21): attached terminal glyceryl moeity or 3'-3 attached inverted deoxyabasic (optionally present)
nnnnnnnnnnnnnnnnnnnnn

SEQ ID NO: 2164 - DNA, 21 bp, Artificial Sequence
  Description of Artificial Sequence:  siNA sense region
  misc_feature (1)..(19): n stands for any ribonucleotide wherein any pyrimidine nucleotide present is 2'-Fluoro or 2'-OCF3 and any purine in 2'-deoxy
  misc_feature (20)..(21): n stands for any nucleotide
  misc_feature (20)..(21): optional phosphorothioate or phosphorodithioate internucleotide linkage
  misc_feature (21)..(21): attached terminal glyceryl moeity or 3'-3 attached inverted deoxyabasic (optionally present)
nnnnnnnnnnnnnnnnnnnnn

SEQ ID NO: 2165 - DNA, 21 bp, Artificial Sequence
  Description of Artificial Sequence:  siNA sense region
  misc_feature (1)..(1): 5'-3 attached terminal deoxyabasic moeity, inverted abasic, inverted nucleotide or other terminal cap that is optionally present
  misc_feature (21)..(21): 3'-3 attached terminal deoxyabasic moeity, inverted abasic, inverted nucleotide or other terminal cap that is optionally present
  misc_feature (1)..(19): ribonucleotide unmodified or modified as described for this sequence
gcgggccuugccuacuauutt

SEQ ID NO: 2166 - DNA, 21 bp, Artificial Sequence
  Description of Artificial Sequence:  siNA antisense region
  misc_feature (20)..(20): Phosphorothioate or Phosphorodithioate 3'-Internucleotide Linkage (optionally present)
  misc_feature (1)..(19): ribonucleotide unmodified or modified as described for this sequence
  misc_feature (21)..(21): attached terminal glyceryl moeity or 3'-3 attached inverted deoxyabasic (optionally present)
aauaguaggcaaggcccgctt

SEQ ID NO: 2167 - DNA, 21 bp, Artificial Sequence
  Description of Artificial Sequence:  siNA sense region
  misc_feature (1)..(1): 2'-O-Methyl
  misc_feature (3)..(5): 2'-O-Methyl
  misc_feature (10)..(10): 2'-O-Methyl
  misc_feature (14)..(14): 2'-O-Methyl
  misc_feature (17)..(17): 2'-O-Methyl
  misc_feature (2)..(2): 2'-deoxy-2'-Fluoro or 2'-OCF3
  misc_feature (6)..(9): 2'-deoxy-2'-Fluoro or 2'-OCF3
  misc_feature (11)..(13): 2'-deoxy-2'-Fluoro or 2'-OCF3
  misc_feature (15)..(16): 2'-deoxy-2'-Fluoro or 2'-OCF3
  misc_feature (18)..(19): 2'-deoxy-2'-Fluoro or 2'-OCF3
  misc_feature (1)..(19): ribonucleotide unmodified or modified as described for this sequence
  misc_feature (20)..(20): Phosphorothioate or Phosphorodithioate 3'-Internucleotide Linkage (optionally present)
gcgggccuugccuacuauutt

SEQ ID NO: 2168 - DNA, 21 bp, Artificial Sequence
  Description of Artificial Sequence:  siNA antisense region
  misc_feature (1)..(2): 2'-O-Methyl
  misc_feature (4)..(5): 2'-O-Methyl
  misc_feature (7)..(9): 2'-O-Methyl
  misc_feature (11)..(14): 2'-O-Methyl
  misc_feature (18)..(18): 2'-O-Methyl
  misc_feature (3)..(3): 2'-deoxy-2'-Fluoro or 2'-OCF3
  misc_feature (6)..(6): 2'-deoxy-2'-Fluoro or 2'-OCF3
  misc_feature (10)..(10): 2'-deoxy-2'-Fluoro or 2'-OCF3
  misc_feature (15)..(17): 2'-deoxy-2'-Fluoro or 2'-OCF3
  misc_feature (19)..(19): 2'-deoxy-2'-Fluoro or 2'-OCF3
  misc_feature (20)..(20): Phosphorothioate or Phosphorodithioate 3'-Internucleotide Linkage (optionally present)
  misc_feature (1)..(19): ribonucleotide unmodified or modified as described for this sequence
  misc_feature (21)..(21): attached terminal glyceryl moeity or 3'-3 attached inverted deoxyabasic (optionally present)
aauaguaggcaaggcccgctt

SEQ ID NO: 2169 - DNA, 21 bp, Artificial Sequence
  Description of Artificial Sequence:  siNA sense region
  misc_feature (2)..(2): 2'-OCF3 or 2'-deoxy-2'-Fluoro
  misc_feature (6)..(9): 2'-OCF3 or 2'-deoxy-2'-Fluoro
  misc_feature (11)..(13): 2'-OCF3 or 2'-deoxy-2'-Fluoro
  misc_feature (15)..(16): 2'-OCF3 or 2'-deoxy-2'-Fluoro
  misc_feature (18)..(19): 2'-OCF3 or 2'-deoxy-2'-Fluoro
  misc_feature (1)..(1): 5'-3 attached terminal deoxyabasic moeity, inverted abasic, inverted nucleotide or other terminal cap that is optionally present
  misc_feature (21)..(21): 3'-3 attached terminal deoxyabasic moeity, inverted abasic, inverted nucleotide or other terminal cap that is optionally present
  misc_feature (1)..(19): ribonucleotide unmodified or modified as described for this sequence
gcgggccuugccuacuauutt

SEQ ID NO: 2170 - DNA, 21 bp, Artificial Sequence
  Description of Artificial Sequence:  siNA antisense region
  misc_feature (3)..(3): 2'-OCF3 or 2'-deoxy-2'-Fluoro
  misc_feature (6)..(6): 2'-OCF3 or 2'-deoxy-2'-Fluoro
  misc_feature (10)..(10): 2'-OCF3 or 2'-deoxy-2'-Fluoro
  misc_feature (15)..(17): 2'-OCF3 or 2'-deoxy-2'-Fluoro
  misc_feature (19)..(19): 2'-OCF3 or 2'-deoxy-2'-Fluoro
  misc_feature (1)..(19): ribonucleotide unmodified or modified as described for this sequence
  misc_feature (20)..(20): Phosphorothioate or Phosphorodithioate 3'-Internucleotide Linkage (optionally present)
  misc_feature (21)..(21): attached terminal glyceryl moeity or 3'-3 attached inverted deoxyabasic (optionally present)
aauaguaggcaaggcccgctt

SEQ ID NO: 2171 - DNA, 21 bp, Artificial Sequence
  Description of Artificial Sequence:  siNA sense region
  misc_feature (1)..(1): 2'-deoxy
  misc_feature (3)..(5): 2'-deoxy
  misc_feature (10)..(10): 2'-deoxy
  misc_feature (14)..(14): 2'-deoxy
  misc_feature (17)..(17): 2'-deoxy
  misc_feature (2)..(2): 2'-OCF3 or 2'-deoxy-2'-Fluoro
  misc_feature (6)..(9): 2'-OCF3 or 2'-deoxy-2'-Fluoro
  misc_feature (11)..(13): 2'-OCF3 or 2'-deoxy-2'-Fluoro
  misc_feature (15)..(16): 2'-OCF3 or 2'-deoxy-2'-Fluoro
  misc_feature (18)..(19): 2'-OCF3 or 2'-deoxy-2'-Fluoro
  misc_feature (1)..(1): 5'-3 attached terminal deoxyabasic moeity, inverted abasic, inverted nucleotide or other terminal cap that is optionally present
  misc_feature (21)..(21): 3'-3 attached terminal deoxyabasic moeity, inverted abasic, inverted nucleotide or other terminal cap that is optionally present
  misc_feature (1)..(19): ribonucleotide unmodified or modified as described for this sequence
gcgggccuugccuacuauutt

SEQ ID NO: 2172 - DNA, 21 bp, Artificial Sequence
  Description of Artificial Sequence:  siNA sense region
  misc_feature (2)..(2): 2'-OCF3 or 2'-deoxy-2'-Fluoro
  misc_feature (6)..(9): 2'-OCF3 or 2'-deoxy-2'-Fluoro
  misc_feature (11)..(13): 2'-OCF3 or 2'-deoxy-2'-Fluoro
  misc_feature (15)..(16): 2'-OCF3 or 2'-deoxy-2'-Fluoro
  misc_feature (18)..(19): 2'-OCF3 or 2'-deoxy-2'-Fluoro
  misc_feature (1)..(1): 5'-3 attached terminal deoxyabasic moeity, inverted abasic, inverted nucleotide or other terminal cap that is optionally present
  misc_feature (21)..(21): 3'-3 attached terminal deoxyabasic moeity, inverted abasic, inverted nucleotide or other terminal cap that is optionally present
  misc_feature (1)..(19): ribonucleotide unmodified or modified as described for this sequence
aauaguaggcaaggcccgctt

SEQ ID NO: 2173 - DNA, 21 bp, Artificial Sequence
  Description of Artificial Sequence:  siNA sense region
  misc_feature (1)..(2): 2'-deoxy
  misc_feature (4)..(5): 2'-deoxy
  misc_feature (7)..(9): 2'-deoxy
  misc_feature (11)..(14): 2'-deoxy
  misc_feature (18)..(18): 2'-deoxy
  misc_feature (3)..(3): 2'-OCF3 or 2'-deoxy-2'-Fluoro
  misc_feature (6)..(6): 2'-OCF3 or 2'-deoxy-2'-Fluoro
  misc_feature (10)..(10): 2'-OCF3 or 2'-deoxy-2'-Fluoro
  misc_feature (15)..(17): 2'-OCF3 or 2'-deoxy-2'-Fluoro
  misc_feature (19)..(19): 2'-OCF3 or 2'-deoxy-2'-Fluoro
  misc_feature (21)..(21): 3'-3 attached terminal deoxyabasic moeity, inverted abasic, inverted nucleotide or other terminal cap that is optionally present
  misc_feature (20)..(20): Phosphorothioate or Phosphorodithioate 3'-Internucleotide Linkage (optionally present)
  misc_feature (1)..(19): ribonucleotide unmodified or modified as described for this sequence
aauaguaggcaaggcccgctt

SEQ ID NO: 2174 - RNA, 14 nt, Artificial Sequence
  Description of Artificial Sequence:  Complementary Sequence/duplex forming oligonucleotide
auauaucuauuucg

SEQ ID NO: 2175 - RNA, 14 nt, Artificial Sequence
  Description of Artificial Sequence:  Complementary Sequence/duplex forming oligonucleotide
cgaaauagauauau

SEQ ID NO: 2176 - RNA, 22 nt, Artificial Sequence
  Description of Artificial Sequence:  Self Complementary duplex construct
cgaaauagauauaucuauuucg

SEQ ID NO: 2177 - DNA, 24 bp, Artificial Sequence
  Description of Artificial Sequence:  Duplex forming oligonucleotide
  misc_feature (1)..(22): ribonucleotide unmodified or modified as described for this sequence
cgaaauagauauaucuauuucgtt

What we claim is:

1. A composition comprising a first double stranded nucleic acid molecule and a second double stranded nucleic acid molecule, each having a first strand and a second strand that are independently 15 to 30 nucleotides in length and wherein at least 15 nucleotides of the first strand are complementary to the second strand, and wherein at least 15 nucleotides of the second strand of said first double stranded nucleic acid molecule are complementary to a first HCV sequence that is SEQ ID NO: 1444 and at least 15 nucleotides of the second strand of said second double stranded nucleic acid molecule are complementary to a second HCV sequence that is SEQ ID NO: 1417.

2. The composition of claim 1, further comprising a cationic lipid, a neutral lipid, and a polyethyleneglycol-conjugate.

3. The composition of claim 1, further comprising a cationic lipid, a neutral lipid, a polyethyleneglycol-conjugate, and a cholesterol.

4. The composition of claim 1, further comprising a cationic lipid, a neutral lipid, a polyethyleneglycol-conjugate, a cholesterol, and a surfactant.

5. The composition of any one of claims 2 to 4, wherein said cationic lipid is CLinDMA.

6. The composition of any one of claims 2 to 4, wherein said neutral lipid is DSPC.

7. The composition of any one of claims 2 to 4, wherein said polyethyleneglycol-conjugate is a PEG-dimyristoyl glycerol.

8. The composition of claim 7, wherein said PEG is 2KPEG.

9. The composition of claim 4, wherein said surfactant is linoleyl alcohol.

10. The composition of claim 4, wherein said cationic lipid is CLinDMA, said neutral lipid is DSPC, said polyethylene glycol conjugate is 2KPEG-DMG, said cholesterol is cholesterol, and said surfactant is linoleyl alcohol.

11. The composition of claim 10, wherein said CLinDMA, said DSPC, said 2KPEG-DMG, said cholesterol, and said linoleyl alcohol are present in molar ratio of 43:38:10:2:7 respectively.

12. The composition of claim 1, wherein said first strand and said second strand of said first double stranded nucleic acid molecule comprise SEQ ID NOs: 1796 and 2102, respectively, and said first strand and said second strand of said second double stranded nucleic acid molecule comprise SEQ ID NOs: 1677 and 2103, respectively.

13. A composition comprising the composition of any one of claims 1-4 in a pharmaceutically acceptable carrier or diluent.

* * * * *